(12) United States Patent
Uil et al.

(10) Patent No.: US 11,459,583 B2
(45) Date of Patent: Oct. 4, 2022

(54) ADENOVIRUS VECTORS AND USES THEREOF

(71) Applicant: Janssen Vaccines & Prevention B.V., Leiden (NL)

(72) Inventors: Taco Gilles Uil, Amsterdam (NL); Soumitra Roy, Townsend, DE (US); Jort Vellinga, Voorschoten (NL); Selina Khan, Leiden (NL); Jerome H. Hv. Custers, Alphen aan den Rijn (NL)

(73) Assignee: Janssen Vaccines & Prevention B.V., Leiden (NL)

( * ) Notice: Subject to any disclaimer, the term of this patent is extended or adjusted under 35 U.S.C. 154(b) by 342 days.

(21) Appl. No.: 16/760,565

(22) PCT Filed: Oct. 30, 2018

(86) PCT No.: PCT/EP2018/079719
§ 371 (c)(1),
(2) Date: Apr. 30, 2020

(87) PCT Pub. No.: WO2019/086461
PCT Pub. Date: May 9, 2019

(65) Prior Publication Data
US 2020/0347405 A1 Nov. 5, 2020

(30) Foreign Application Priority Data
Oct. 31, 2017 (EP) .................................. 17199350

(51) Int. Cl.
| C12N 15/86 | (2006.01) |
| A61K 39/235 | (2006.01) |
| C07K 14/005 | (2006.01) |
| C12N 7/00 | (2006.01) |
| A61K 39/00 | (2006.01) |

(52) U.S. Cl.
CPC ............ *C12N 15/86* (2013.01); *A61K 39/235* (2013.01); *C07K 14/005* (2013.01); *C12N 7/00* (2013.01); *A61K 2039/525* (2013.01); *C12N 2710/10322* (2013.01); *C12N 2710/10343* (2013.01)

(58) Field of Classification Search
None
See application file for complete search history.

(56) References Cited

U.S. PATENT DOCUMENTS

| 5,559,099 A | 9/1996 | Wickham et al. |
| 5,837,511 A | 11/1998 | Falck-Pedersen et al. |
| 5,846,782 A | 12/1998 | Wickham et al. |
| 5,851,806 A | 12/1998 | Kovesdi et al. |
| 5,891,690 A | 4/1999 | Massie |
| 5,965,541 A | 10/1999 | Wickham et al. |
| 5,981,225 A | 11/1999 | Kochanek et al. |
| 5,994,106 A | 11/1999 | Kovesdi et al. |
| 5,994,128 A | 11/1999 | Fallaux et al. |
| 6,020,191 A | 2/2000 | Scaria et al. |
| 6,040,174 A | 3/2000 | Imler et al. |
| 6,113,913 A | 9/2000 | Brough et al. |

FOREIGN PATENT DOCUMENTS

| EP | 2 350 268 | 8/2011 |
| EP | 2 536 829 | 12/2012 |
| WO | 98/39411 | 9/1998 |
| WO | 01/36615 | 5/2001 |
| WO | 2002/22080 | 3/2002 |
| WO | 2003/000283 | 1/2003 |
| WO | 2003/104467 | 12/2003 |
| WO | 2004/037189 | 5/2004 |
| WO | 2005/071093 | 8/2005 |
| WO | 2006/040330 | 4/2006 |
| WO | 2007/104792 | 9/2007 |
| WO | 2009/073104 | 6/2009 |
| WO | 2010/086189 | 8/2010 |
| WO | 2001/02607 | 1/2011 |
| WO | 2011/130627 | 10/2011 |
| WO | 2013/016591 | 1/2013 |
| WO | 2013/052859 | 4/2013 |
| WO | 2013/173702 | 11/2013 |

OTHER PUBLICATIONS

Roberts, et al., Nature, vol. 441, pp. 239-243 (Year: 2006).*
Altschul et al., "Basic Local Alignment Search Tool," (1990) J. Mol. Biol. 215: 403-410.
Altschul et al., "Gapped BLAST and PSI-BLAST: a new generation of protein database search programs," (1997) Nucleic Acids Res. 25: 3389-3402.
Barnes E, et al., "Novel Adenovirus-Based Vaccines Induce Broad and Sustained T Cell Responses to HCV in Man," 2012 Science translational medicine 4: 115ra1.
Fallaux et al., "New Helper Cells and Matched Early Region 1-Deleted Adenovirus Vectors Prevent Generation of Replication-Competent Adenovirus," 1998, Hum Gene Ther 9:1909-17.
Gao et al., "A Cell Line for High-Yield Production of E1-Deleted Adenovirus Vectors without the Emergence of Replication-Competent Virus," 2000, Hum Gene Ther 11: 213-19.
Havenga et al., "Novel replication-incompetent adenoviral B-group vectors: high vector stability and yield in PER.C6 cells," J. Gen. Virol. 87(8):2135-43 (2006).
Henikoff & Henikoff, Proc. Natl. Acad. Sci. USA 89:10915 (1989).
Karlin & Altschul, "Amino acid substitution matrices from protein blocks," Proc. Nat'l. Acad. Sci. USA, 90: 5873-5787 (1993).
Kovesdi et al., "Adenoviral Producer Cells," 2010, Viruses 2: 1681-703.
Letvin et al., "Prospects for Vaccine Protection Against HIV-1 Infection and AIDS," Ann. Rev. Immunol. 20:73 (2002).
Maizel et al., "The Polypeptides of Adenovirus," Virology, 36(1):115-25 (1968).
Needleman & Wunsch, "A General Method Applicable to the Search for Similarities in the Amino Acid Sequence of Two Proteins," J. Mol. Biol. 48:443 (1970).

(Continued)

*Primary Examiner* — Shanon A. Foley
*Assistant Examiner* — Myron G Hill
(74) *Attorney, Agent, or Firm* — Ice Miller LLP

(57) ABSTRACT

Provided herein are chimeric adenoviral vectors. The provided chimeric adenoviral vectors can be used to induce a protective immune response in a subject.

14 Claims, 12 Drawing Sheets

Specification includes a Sequence Listing.

(56) References Cited

OTHER PUBLICATIONS

Pearson & Lipman, "Improved tools for biological sequence comparison," Proc. Nat'l. Acad. Sci. USA 85:2444 (1988).
Peruzzi D, et al., A novel Chimpanzee serotype-based adenoviral vector as delivery tool for cancer vaccines, 2009 Vaccine 27:1293-300.
Quinn KM, et al., "Comparative Analysis of the Magnitude, Quality, Phenotype, and Protective Capacity of Simian Immunodeficiency Virus Gag-Specific CD8 T Cells following Human-, Simian-, and Chimpanzee-Derived Recombinant Adenoviral Vector Immunization," 2013, J Immunol 190: 2720-35.
Shiver et al., "Replication-incompetent adenoviral vacccine vector elicits effective anti-immunodeficiency-virus immunity," Nature 415:331 (2002).
Shiver and Emini, "Recent Advances in the Development of HIV-1 Vaccines Using Replication-Incompetent Adenovirus Vectors," Ann. Rev. Med 55:355 (2004).
Smith & Waterman, "Comparison of Biosequences," Adv. Appl. Math. 2:482 (1981).
Sprangers et al., "Quantifying Adenovirus-Neutralizing Antibodies by Luciferase Transgene Detection: Addressing Preexisting Immunity to Vaccine and Gene Therapy Vectors," 2003, J.Clin. Microbiol. 41:5046-5052.
Susan J. Morris et al., "Simian adenoviruses as vaccine vectors," Future Virology, 11(9):649-659, 2016.
R.R. Bradley et al., "Adenovirus Serotype 5 Neutralizing Antibodies Target both Hexon and Fiber following Vaccination and Natural Infection," Journal of Virology, 86(1):625-629, 2011.
S.C. Jacobs, "Characterization and manipulation of the human adenovirus 4 genome," Journal of General Virology, 85 (11):3361-3366, 2004.
Roberts Diane M. et al., "Hexon-chimaeric adenovirus serotype 5 vectors circumvent pre-existing anti-vector immunity," Nature, Macmillan Journals Ltd., London, 441 (7090):239-243, 2006.
Julio Alonso-Padilla et al., "Development of Novel Adenoviral Vectors to Overcome Challenges Observed with HAdV-5-based Constructs," Molecular Therapy: The Journal of the American Society of Gene Therapy, 24(1):6-16, 2015.

Mohan Babu Appaiahgari et al., "Adenoviruses as gene/vaccine delivery vectors: promises and pitfalls," Expert Opinion on Biological Therapy, 15(3):337-351, 2014.
Abbink et al., "Comparative Seroprevalence and Immunogenicity of Six Rare Serotype Recombinant Adenovirus Vaccine Vectors from Subgroups B and D," Journal of Virology, 81(9):4654-4663, 2007.
Alba et al., "Vector Systems for Prenatal Gene Therapy: Principles of Adenovirus Design and Production," Methods in Molecular Biology, 891:55-84, 2012.
Bradley, et al., "Adenovirus Serotype 5-Specific Neutralizing Antibodies Target Multiple Hexon Hypervariable Regions," Journal of Virology, 86:1267-72, 2012.
Bruder et al., "Modification of Ad5 Hexon Hypervariable Regions Circumvents Pre-Existing Ad5 Neutralizing Antibodies and Induces Protective Immune Responses," PLoS One, 7(4):e33920, 2012.
Gall et al., "Construction and Characterization of Hexon-Chimeric Adenoviruses: Specification of Adenovirus Serotype," Journal of Virology, 72(12):10260-10264, 1998.
Ma et al., "Synergistic suppression effect on tumor growth of hepatocellular carcinoma by combining oncolytic adenovirus carrying XAF1 with cisplatin," J Cancer Res Clin Oncol, 141:419-429, 2015.
Roy et al., "Circumvention of Immunity to the Adenovirus Major Coat Protein Hexon," Journal of Virology, 72(8):6875-6879, 1998.
Roy et al., "Use of chimeric adenoviral vectors to assess capsid neutralization determinants," Virology, 333:207-214, 2005.
Wu et al., "Construction and Characterization of Adenovirus Serotype 5 Packages by Serotype 3 Hexon," Journal of Virology, 76(24):12775-12782, 2002.
Youil et al., "Hexon Gene Switch Strategy for the Generation of Chimeric Recombinant Adenovirus," Human Gene Therapy, 13:311-320, 2002.
Yu et al., "Chimeric hexon HVRs protein reflects partial function of adenovirus," Biochemical and Biophysical Research Communication, 421:170-176, 2012.
Wevers et al., "Novel Adenoviruses in Wild Primates: a High Level of Genetic Diversity and Evidence of Zoonotic Transmissions," Journal of Virology, 85(20):10774-10784, 2011.
Ma et al., "Manipulating Adenovirus Hexon Hypervariable Loops Dictates Immune Neutralisation and Coagulation Factor X-dependent Cell Interaction In Vitro and In Vivo," PLoS Pathog, 11(2):e1004673, 2015.

\* cited by examiner

ADENOVIRUS VECTORS AND USES THEREOF

CROSS-REFERENCE TO RELATED APPLICATIONS

This application is a Section 371 of International Application No. PCT/EP2018/079719, filed Oct. 30, 2018, which was published in the English language on May 9, 2019 under International Publication No. WO 2019/086461 A1, and claims priority under 35 U.S.C. § 119(b) to European Application No. 17199350.4, filed Oct. 31, 2017, the disclosures of which are incorporated herein by reference in their entirety.

REFERENCE TO SEQUENCE LISTING SUBMITTED ELECTRONICALLY

This application contains a sequence listing, which is submitted electronically via EFS-Web as an ASCII formatted sequence listing with a file name "065768.11634 SL," creation date of Apr. 29, 2020, and having a size of 886 KB. The sequence listing submitted via EFS-Web is part of the specification and is herein incorporated by reference in its entirety.

FIELD OF THE INVENTION

This invention relates to biotechnology. More particularly, to the field and use of adenoviral vectors, such as replication deficient adenoviral vectors to deliver antigens and elicit an immune response in hosts.

BACKGROUND OF THE INVENTION

Recombinant adenoviral vectors are widely applied for gene therapy applications and vaccines. AdV-5 vector-based vaccines have been shown to elicit potent and protective immune responses in a variety of animal models (see, e.g., WO2001/02607; WO2002/22080; Shiver et al., Nature 415: 331 (2002); Letvin et al., Ann. Rev. Immunol. 20:73 (2002); Shiver and Emini, Ann. Rev. Med. 55:355 (2004)). However, the utility of recombinant AdV-5 vector-based vaccines will likely be limited by the high seroprevalence of AdV-5-specific neutralizing antibodies (NAbs) in human populations. The existence of anti-AdV-5 immunity has been shown to substantially suppress the immunogenicity of AdV-5-based vaccines in studies in mice, rhesus monkeys, and humans.

One promising strategy to circumvent the existence of pre-existing immunity in individuals previously infected or treated with the most common human adenovirus, e.g., AdV-5, involves the development of recombinant vectors from adenovirus serotypes that do not encounter such pre-existing immunities. One such strategy is based on the use of chimeric adenoviruses comprising replacement of native capsid protein sequences (e.g., hexon and/or fiber protein sequences) with capsid protein sequences (e.g., hexon and/or fiber protein sequences) from adenoviruses with low (or no) seroprevalence.

Thus, there is a need in the field for alternative adenoviral vectors that are producible in large quantities, that do not encounter pre-existing immunities in the host, but that are still immunogenic and capable of inducing a strong immune response against the antigens encoded by the heterologous nucleic acids inserted in the vector.

BRIEF SUMMARY OF THE INVENTION

Provided herein are adenoviral vectors. The adenoviral vector can comprise a nucleic acid sequence encoding a hexon polypeptide comprising a hexon hypervariable regions-encompassing polypeptide comprising an amino acid sequence selected from SEQ ID NO:1 or SEQ ID NO:2. In certain embodiments, the adenoviral vector can comprise the hexon polypeptide sequence comprising SEQ ID NO:3 or SEQ ID NO:4.

In certain embodiments, the adenoviral vector further comprises an E1 deletion. In certain embodiments, the adenoviral vector further comprises an E3 deletion. The adenoviral vector can further comprise a human adenovirus-5 (HAdV-5) E4 orf6. The adenoviral vector can, for example, comprise a nucleic acid sequence selected from SEQ ID NO:5 or SEQ ID NO:6.

In certain embodiments, the adenoviral vector further comprises at least one transgene. In certain embodiments, the at least one transgene is located at the E1 deletion, at the E3 deletion, and/or adjacent to the right inverted terminal repeat (rITR).

In certain embodiments, the adenoviral vector comprises one or more nucleic acid sequences from human adenovirus-26 (Ad26).

Also provided are recombinant cells comprising the adenoviral vectors described herein. Also provided are methods of producing the adenoviral vectors.

The methods comprise (a) growing the recombinant cells described herein under conditions for production of the adenoviral vector; and (b) isolating the adenoviral vector from the recombinant cell.

Also provided are immunogenic compositions comprising the adenoviral vectors described herein and a pharmaceutically acceptable carrier. Also provided are methods of inducing an immune response in a subject in need thereof. The methods comprise administering to the subject the immunogenic compositions described herein. Also provided are methods of producing the immunogenic compositions, the methods comprise combining the adenoviral vectors described herein with a pharmaceutically acceptable carrier.

BRIEF DESCRIPTION OF THE DRAWINGS

The foregoing summary, as well as the following detailed description of preferred embodiments of the present application, will be better understood when read in conjunction with the appended drawings. It should be understood, however, that the application is not limited to the precise embodiments shown in the drawings.

FIG. 1A shows a schematic demonstrating the locations in the full length HAdV-26 hexon gene (open bar) of the five hexon gene segments (grey bars) and the seven short hypervariable regions (HVRs) (black bars) that were swapped previously between HAdV-5 and HAdV-48 hexons to generate the hexon-chimeric HAdV-5 vector Ad5HVR48 (1-7) (Roberts et al., Nature 441:239-43 (2006)). FIG. 1B shows a partial alignment of the hexon polypeptide sequences of HAdV-26, PtroAdV-1, PtroAdV-12, and PtroAdV-13. Grey bars correspond to the five hexon gene segments swapped herein between HAdV-26 and PtroAdV-1, PtroAdV-12, or PtroAdV-13. Black bars indicate the sequences corresponding to the above-mentioned previously assigned HVRs that were swapped between HAdV-5 and HAdV-48.

FIG. 2A shows a schematic of the general features of pAd26.HVRPtr12.luc (SEQ ID NO:21). FIG. 2B shows a schematic of the general features of pAd26.HVRPtr13.luc (SEQ ID NO:22).

FIG. 5A shows the experimental set-up. FIG. 5B shows a graph of the immune response induced by Ad26.FLuc, Ad26HVRPtr12.FLuc and Ad26HVRPtr13.FLuc against the vector-encoded antigen (i.e. Fluc, firefly luciferase) as determined by interferon gamma (IFN-γ) ELISPOT analysis. The y-axis shows the number of Spot Forming Units (SFU) per $10^6$ splenocytes and the dotted line indicates 95% percentile of the medium stimuli.

FIG. 6A shows the experimental set-up. FIG. 6B shows results of a RSV A2 virus neutralization assay (VNA) performed at eight weeks after immunization with Ad26.RSVF-2A-GLuc, Ad26HVRPtr12.RSVF-2A-GLuc and Ad26HVRPtr13.RSVF-2A-GLuc. FIG. 6C shows the cellular immune response induced by Ad26.RSVF-2A-GLuc, Ad26HVRPtr12.RSVF-2A-GLuc and Ad26HVRPtr13.RSVF-2A-GLuc against the vector-encoded antigen RSV F as determined by IFN-γ ELISPOT analysis. The y-axis shows the number of Spot Forming Units (SFU) per $10^6$ splenocytes and the dotted line indicates 95% percentile of the medium stimuli. FIG. 6D shows a graph of RSVF-specific IgG binding antibodies induced by Ad26.RSVF-2A-GLuc, Ad26HVRPtr12.RSVF-2A-GLuc and Ad26HVRPtr13.RSVF-2A-GLuc in serum of immunized mice at 8 weeks post-immunization. The graph depicts IgG ELISA titers calculated as endpoint titers ($\log_{10}$).

DETAILED DESCRIPTION OF THE INVENTION

Figures 1A, 1B:
FIG. 1A-FIG. 1B show a schematic of the hexon sequence replacements of the hexon-chimeric vectors described herein.

This disclosure is based upon, at least in part, the creation of chimeric adenoviral vectors comprising a human backbone and at least one of a chimeric hexon or fiber polypeptide sequences. The adenoviral vectors are capable of eliciting an immune response, while maintaining low seroprevalence. The adenoviral vectors can be formulated for vaccines and used to induce protective immunity against specific antigens of interest.

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series. Those skilled in the art will recognize or be able to ascertain using no more than routine experimentation, many equivalents to the specific embodiments of the invention described herein. Such equivalents are intended to be encompassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or", a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human, to whom will be or has been vaccinated by a method according to an embodiment of the invention. The term "mammal" as used herein, encompasses any mammal. Examples of mammals include, but are not limited to, cows, horses, sheep, pigs, cats, dogs, mice, rats, rabbits, guinea pigs, monkeys, humans, etc., more preferably a human.

The words "right", "left", "lower" and "upper" designate directions in the drawings to which reference is made.

It should also be understood that the terms "about," "approximately," "generally," "substantially" and like terms, used herein when referring to a dimension or characteristic of a component of the preferred invention, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., hexon and fiber polypeptides and polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, *Current Protocols in Molecular Biology*, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) *J. Mol. Biol.* 215: 403-410 and Altschuel et al. (1977) *Nucleic Acids Res.* 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions, as described below.

As used herein, the term "protective immunity" or "protective immune response" means that the vaccinated subject is able to control an infection with the pathogenic agent against which the vaccination was done. The pathogenic agent can, for example, be an antigenic gene product or antigenic protein, or a fragment thereof. Usually, the subject having developed a "protective immune response" develops only mild to moderate clinical symptoms or no symptoms at all. Usually, a subject having a "protective immune response" or "protective immunity" against a certain agent will not die as a result of the infection with said agent.

The terms "adjuvant" is defined as one or more substances that cause stimulation of the immune system. In this context, an adjuvant is used to enhance an immune response to the adenovirus vectors of the invention.

As used herein, the term "antigenic gene product or fragment thereof" or "antigenic protein" can include a bacterial, viral, parasitic, or fungal protein, or a fragment thereof. Preferably, an antigenic protein or antigenic gene product is capable of raising in a host a protective immune response, e.g., inducing an immune response against a disease or infection (e.g., a bacterial, viral, parasitic, or fungal disease or infection), and/or producing an immunity in (i.e., vaccinating) a subject against a disease or infection, that protects the subject against the disease or infection.

As used herein, the term "chimeric" means a gene, nucleic acid, protein, peptide or polypeptide that comprises two or more genes, nucleic acids, proteins, peptides or polypeptides not normally associated together. A "chimeric" gene, nucleic acid, or protein can be a fusion between two or more unrelated sequences (e.g., two or more distinct nucleic acids that encode two or more distinct proteins). A "chimeric" gene, nucleic acid, or protein can be a fusion between two or more related sequences (e.g., the nucleic acids encode the same protein, however, the nucleic acids are derived from a different source material, i.e., one nucleic acid is human and the other nucleic acid is simian).

Adenoviral Vectors

Exposure to certain adenoviruses has resulted in immune responses against certain adenoviral serotypes, which can affect efficacy of adenoviral vectors. Because infections with human adenoviruses are common in humans, the prevalence of neutralizing antibodies against human adenoviruses in human populations is high. The presence of such neutralizing antibodies in individuals may be expected to reduce the efficacy of a gene transfer vector based on a human adenoviral backbone. One way to circumvent the reduction of efficacy is to replace the epitopes on the adenoviral capsid proteins that are the targets of neutralizing antibodies. The target sequences on the capsid proteins can be replaced with protein sequences from other adenoviruses (e.g., simian adenoviruses) which are of low prevalence, and therefore against which neutralizing antibodies are rare in human populations.

A "capsid protein" refers to a protein on the capsid of an adenovirus or a functional fragment or derivative thereof that is involved in determining the serotype and/or tropism of a particular adenovirus. Capsid proteins typically include the fiber, penton, and/or hexon proteins. In certain embodiments, the capsid protein is an entire or full length capsid protein of the adenovirus. In other embodiments, the capsid protein is a fragment or a derivative of a full length capsid protein of the adenovirus. In certain embodiments, the hexon, penton and fiber encoded by an adenoviral vector of the invention are of the same or different adenoviral background.

A "hexon polypeptide" refers to adenovirus hexon coat proteins, functional fragments, and derivatives thereof.

A "fiber polypeptide" refers to adenovirus fiber proteins, functional fragments, and derivatives thereof.

One target of neutralizing antibodies against adenoviruses is the major coat protein, the hexon protein. Replacing the hexon protein or variable sequences within the hexon protein, which define serotype and bind to neutralizing antibodies, with the hexon protein or variable sequences within the hexon protein from adenoviruses that are rare in the human population can allow for the construction of adenovirus vectors that would be less susceptible to neutralization by antibodies commonly found in humans.

Hexon hypervariable regions (HVRs) are regions of the hexon polypeptide representing the highest variability among the different adenoviral serotypes. In general, these HVRs are thought to correspond to the solvent-exposed surfaces of the hexon protein trimer (within the context of the intact viral particle) and, relatedly, they are expected to be important determinants of antibody-mediated adenovirus neutralization (Roberts et al., Nature 441:239-43 (2006)). Replacement of the hexon HVRs of a given adenoviral vector by those of an adenovirus with low (or no) seroprevalence in humans therefore represents a possible means to circumvent pre-existing anti-vector humoral immunity in human target populations. Consequently, there have been multiple studies exploring the concept of hexon-chimerism, mostly involving hexon sequence replacements within HAdV-5-based vectors (Roy et al., J Virol. 72:6875-9 (1998); Gall et al., J Virol. 72:10260-4 (1998); Youil et al., Hum. Gene Ther. 13:311-20 (2002); Wu et al. J Virol. 76:12775-82 (2002); Roy et al., Virology. 333:207-14 (2005); Roberts et al., Nature 441:239-43 (2006); Bradley et al., J Virol. 86:1267-72 (2012); Yu et al., Biochem Biophys Res Commun. 421:170-6 (2012); Bruder et al, PLoS One. 7(4):e33920 (2012)).

A second target of neutralizing antibodies against adenoviruses is the fiber protein. Replacing the fiber protein with fiber sequences from rare adenoviruses that are of non-human origin, more preferably replacing the variable sequences within the fiber protein, can also allow for the construction of adenovirus vectors that would be less susceptible to neutralization by antibodies commonly found in humans. A combination of the fiber replacement with hexon replacements described above can confer additional resistance to neutralization by antibodies commonly present in human populations.

This disclosure provides chimeric adenoviral vectors comprising transgenes and chimeric hexon nucleic acid sequences. The adenoviral vectors can, for example, comprise a nucleic acid sequence encoding a hexon polypeptide comprising a hexon hypervariable regions-encompassing polypeptide comprising an amino acid sequence selected from SEQ ID NO:1 or SEQ ID NO:2. In certain embodiments, the hexon polypeptide sequence comprises SEQ ID NO:3 or SEQ ID NO:4. The adenoviral vector can, for example, comprise one or more nucleic acid sequences from human adenovirus-4, human adenovirus-5, human adenovirus-26, or human adenovirus-35. In certain embodiments, the adenoviral vector comprises a nucleic acid sequence selected from SEQ ID NO:5 or SEQ ID NO:6.

An "adenoviral vector" refers to a recombinant vector derived from or containing at least a portion of an adenoviral genome.

Typically, an adenoviral vector of the invention comprises the entire recombinant adenoviral genome on, e.g., a plasmid, cosmid, or baculovirus vector. The nucleic acid molecules of the invention can be in the form of RNA or in the form of DNA obtained by cloning or produced synthetically. The DNA can be double-stranded or single-stranded.

One of ordinary skill will recognize that elements derived from multiple serotypes can be combined in a single adenoviral vector, for example human or simian adenovirus. Thus, a chimeric adenovirus vector that combines desirable properties from different serotypes can be produced. Thus, in some embodiments, a chimeric adenovirus vector of the invention could combine the absence of pre-existing immunity of a chimeric hexon and/or fiber polypeptide sequences with the high level antigen delivery and presentation capacity of an existing adenoviral vectors, such as rAd4, rAd5, rAd26, or rAd35.

Advantages of adenoviral vectors for use as vaccines include ease of manipulation, good manufacturability at large scale, and an excellent safety record based on many years of experience in research, development, manufacturing and clinical trials with numerous adenoviral vectors that have been reported. Adenoviral vectors that are used as vaccines generally provide a good immune response to the transgene-encoded protein or transgene encoded antigenic gene product, including a cellular immune response. An adenoviral vector according to the invention can be based on any type of adenovirus, and in certain embodiments is a human adenovirus, which can be of any group or serotype. In preferred embodiments, the recombinant adenovirus is based upon a human adenovirus from group A, B, C, D, E, F or G. In other preferred embodiments, the recombinant adenovirus is based upon a human adenovirus serotype 5, 11, 26, 34, 35, 48, 49, or 50. In other embodiments, it is a simian adenovirus, such as chimpanzee or gorilla adenovirus, which can be of any serotype. In certain embodiments, the recombinant adenovirus is based upon chimpanzee adenovirus type 1, 3, 7, 8, 21, 22, 23, 24, 25, 26, 27.1, 28.1, 29, 30, 31.1, 32, 33, 34, 35.1, 36, 37.2, 39, 40.1, 41.1, 42.1, 43, 44, 45, 46, 48, 49, 50, 67, or SA7P.

In a more preferred embodiment, the chimpanzee adenovirus vector of the second composition is ChAdV3. Recombinant chimpanzee adenovirus serotype 3 (ChAd3 or cAd3) is a subgroup C adenovirus with properties similar to those of human adenovirus serotype 5 (Ad5). ChAd3 has been shown to be safe and immunogenic in human studies evaluating candidate vaccines for hepatitis C virus (HCV) (Barnes E, et al. 2012 Science translational medicine 4: 115ra1). It was reported that ChAd3-based vaccines were capable of inducing an immune response comparable to a human Ad5 vectored vaccine. See, e.g., Peruzzi D, et al. 2009 Vaccine 27: 1293-300 and Quinn K M, et al. 2013 J Immunol 190: 2720-35; WO 2005/071093; WO2011/0130627, etc.

Adenoviral vectors, methods for construction thereof and methods for propagating thereof, are well known in the art and are described in, for example, U.S. Pat. Nos. 5,559,099, 5,837,511, 5,846,782, 5,851,806, 5,994,106, 5,994,128, 5,965,541, 5,981,225, 6,040,174, 6,020,191, and 6,113,913, and Thomas Shenk, "Adenoviridae and their Replication", M. S. Horwitz, "Adenoviruses", Chapters 67 and 68, respectively, in *Virology*, B. N. Fields et al., eds., 3d ed., Raven Press, Ltd., New York (1996), and other references mentioned herein. Typically, construction of adenoviral vectors involves the use of standard molecular biological techniques, such as those described in, for example, Sambrook et al., *Molecular Cloning, a Laboratory Manual*, 2d ed., Cold Spring Harbor Press, Cold Spring Harbor, N.Y. (1989), Watson et al., *Recombinant DNA*, 2d ed., Scientific American Books (1992), and Ausubel et al., *Current Protocols in Molecular Biology*, Wiley Interscience Publishers, NY (1995), and other references mentioned herein.

In certain embodiments, the adenoviral vector comprises an E1 deletion and/or an E3 deletion. An E1 or E3 deletion can, for example, include a complete deletion of the gene or a partial deletion, which renders the E1 or E3 gene product functionally defective. Thus, in certain embodiments, the adenovirus is replication deficient, e.g. because it contains a deletion in the E1 region of the genome. As known to the skilled person, in case of deletions of essential regions from the adenovirus genome, the functions encoded by these regions have to be provided in trans, preferably by the producer cell, i.e. when parts or whole of E1, E2 and/or E4 regions are deleted from the adenovirus, these have to be present in the producer cell, for instance integrated in the genome thereof, or in the form of so-called helper adenovirus or helper plasmids. The adenovirus may also have a deletion in the E3 region, which is dispensable for replication, and hence such a deletion does not have to be complemented. One or more of the E1, E2, E3 and E4 regions can also be inactivated by other means, such as by inserting a transgene of interest (usually linked to a promoter) into the regions to be inactivated.

A producer cell (sometimes also referred to in the art and herein as 'packaging cell' or 'complementing cell') that can be used can be any producer cell wherein a desired adenovirus can be propagated. For example, the propagation of recombinant adenovirus vectors is done in producer cells that complement deficiencies in the adenovirus. Such producer cells preferably have in their genome at least an adenovirus E1 sequence, and thereby are capable of complementing recombinant adenoviruses with a deletion in the E1 region. Any E1-complementing producer cell can be used, such as human retina cells immortalized by E1, e.g. 911 or PER.C6 cells (see U.S. Pat. No. 5,994,128), E1-transformed amniocytes (See EP patent 1230354), E1-transformed A549 cells (see e.g. WO 98/39411, U.S. Pat. No. 5,891,690), GH329:HeLa (Gao et al., 2000, *Hum Gene Ther* 11: 213-19), 293, and the like. In certain embodiments, the producer cells are for instance HEK293 cells, or PER.C6 cells, or 911 cells, or IT293SF cells, and the like. Production of adenoviral vectors in producer cells is reviewed in (Kovesdi et al., 2010, *Viruses* 2: 1681-703).

In certain embodiments, the adenoviral vector is a chimeric adenoviral vector comprising one or more human adenoviral nucleic acid sequences. The human adenoviral nucleic acids can, for example, be selected from human adenovirus-4 (Ad-4), human adenovirus-5 (Ad-5), human adenovirus-26 (Ad-26), or human adenovirus-35 (Ad-35). In certain embodiments, an E1-deficient adenoviral vector comprises the E4-orf6 coding sequence of an adenovirus of human Ad5. This allows propagation of such adenoviruses in well-known complementing cell lines that express the E1 genes of Ad5, such as for example 293 cells or PER.C6 cells (see, e.g. Fallaux et al., 1998, *Hum Gene Ther* 9: 1909-17, Havenga et al., 2006, *J Gen Virol* 87: 2135-43; WO 03/104467, incorporated in their entirety by reference herein).

In certain embodiments, the adenoviral vector comprises a transgene. A "transgene" refers to a heterologous nucleic acid, which is a nucleic acid that is not naturally present in the vector, and according to the present invention the transgene can encode an antigenic gene product or antigenic protein that elicits an immune response in the subject. The transgene can, for example, be introduced into the vector by standard molecular biology techniques. The transgene can, for example, be cloned into a deleted E1 or E3 region of an adenoviral vector, or in the region between the E4 region and the rITR. A transgene is generally operably linked to expression control sequences. In preferred embodiments, the transgene is inserted at a transgene insertion site.

If required, the hexon or fiber nucleic acid sequence according to embodiments of the invention, and/or the transgene can be codon-optimized to ensure proper expression in the treated host (e.g., human). Codon-optimization is a technology widely applied in the art.

The transgene can be under the control of (i.e., operably linked to) an adenovirus-derived promoter (e.g., the Major Late Promoter) or can be under the control of a heterologous promoter. Examples of suitable heterologous promoters include the CMV promoter and the RSV promoter. Preferably, the promoter is located upstream of the heterologous gene of interest within an expression cassette.

In preferred embodiments, the adenoviral vector comprises a nucleic acid sequence selected from SEQ ID NO:5 or SEQ ID NO:6.

Immunogenic Compositions

Immunogenic compositions are compositions comprising an immunologically effective amount of purified or partially purified human adenoviral vectors for use in the invention. Said compositions can be formulated as a vaccine (also referred to as an "immunogenic composition") according to methods well known in the art. Such compositions can include adjuvants to enhance immune responses. The optimal ratios of each component in the formulation can be determined by techniques well known to those skilled in the art in view of the present disclosure.

The immunogenic compositions according to embodiments of the present invention can be made using methods known to those of skill in the art in view of the present disclosure. Liquid pharmaceutical compositions generally include a liquid carrier such as water, petroleum, animal or vegetable oils, mineral oil or synthetic oil. Physiological saline solution, dextrose or other saccharide solution or glycols such as ethylene glycol, propylene glycol or polyethylene glycol can be included.

The immunogenic compositions useful in the invention can comprise adjuvants. Adjuvants suitable for co-administration in accordance with the invention should be ones that are potentially safe, well tolerated and effective in people including QS-21, Detox-PC, MPL-SE, MoGM-CSF, TiterMax-G, CRL-1005, GERBU, TERamide, PSC97B, Adjumer, PG-026, GSK-I, ASO1, AS03, AS04, AS15, GcMAF, B-alethine, MPC-026, Adjuvax, CpG ODN, Betafectin, Alum, and MF59.

Other adjuvants that can be administered include lectins, growth factors, cytokines and lymphokines such as alpha-interferon, gamma interferon, platelet derived growth factor (PDGF), granulocyte-colony stimulating factor (gCSF), granulocyte macrophage colony stimulating factor (gMCSF), tumor necrosis factor (TNF), epidermal growth factor (EGF), IL-I, IL-2, IL-4, IL-6, IL-8, IL-10, and IL-12 or encoding nucleic acids therefore.

The compositions of the invention can comprise a pharmaceutically acceptable excipient, carrier, buffer, stabilizer or other materials well known to those skilled in the art. Such materials should be non-toxic and should not interfere with the efficacy of the active ingredient. The precise nature of the carrier or other material can depend on the route of administration, e.g., intramuscular, subcutaneous, oral, intravenous, cutaneous, intramucosal (e.g., gut), intranasal or intraperitoneal routes.

Method for Inducing Protective Immunity

Another general aspect of the invention relates to a method of inducing an immune response in a subject in need thereof. The methods can, for example, comprise administering to the subject a vaccine comprising an adenoviral vector described herein and a pharmaceutically acceptable carrier. Also provided herein are methods of producing a vaccine. The methods comprise combining an adenoviral vector described herein with a pharmaceutically acceptable carrier.

Any of the immunogenic compositions according to embodiments of the invention, including but not limited to those described herein, can be used in methods of the invention as a vaccine.

Administration of the immunogenic compositions/vaccines comprising the vectors is typically intramuscular or subcutaneous. However other modes of administration such as intravenous, cutaneous, intradermal or nasal can be envisaged as well. Intramuscular administration of the immunogenic compositions can be achieved by using a needle to inject a suspension of the adenovirus vector. An alternative is the use of a needleless injection device to administer the composition (using, e.g., Biojector™) or a freeze-dried powder containing the vaccine.

For intravenous, cutaneous or subcutaneous injection, or injection at the site of affliction, the vector will be in the form of a parenterally acceptable aqueous solution which is pyrogen-free and has suitable pH, isotonicity and stability. Those of skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives can be included, as required. A slow-release formulation can also be employed.

Typically, administration will have a prophylactic aim to generate an immune response against an antigen of interest (e.g., a bacterial, viral, parasitic, and/or fungal pathogen) before infection or development of symptoms. Diseases and disorders that can be treated or prevented in accordance with the invention include those in which an immune response can play a protective or therapeutic role. In other embodiments, the adenovirus vectors can be administered for post-exposure prophylactics.

The immunogenic compositions containing the chimeric human adenovirus vectors are administered to a subject, giving rise to an immune response to the antigen of interest in the subject. An amount of a composition sufficient to induce a detectable immune response is defined to be an "immunologically effective dose" or an "effective amount" of the composition. The immunogenic compositions of the invention can induce a humoral as well as a cell-mediated immune response. In a typical embodiment the immune response is a protective immune response.

The actual amount administered, and rate and time-course of administration, will depend on the nature and severity of what is being treated. Prescription of treatment, e.g., decisions on dosage etc., is within the responsibility of general practitioners and other medical doctors, or in a veterinary context a veterinarian, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. ed., 1980.

Following production of adenovirus vectors and optional formulation of such particles into compositions, the vectors can be administered to an individual, particularly human or other primate. Administration can be to humans, or another mammal, e.g., mouse, rat, hamster, guinea pig, rabbit, sheep, goat, pig, horse, cow, donkey, monkey, dog or cat. Delivery to a non-human mammal need not be for a therapeutic purpose, but can be for use in an experimental context, for instance in investigation of mechanisms of immune responses to the adenovirus vectors.

In one exemplary regimen, the adenoviral vector is administered (e.g., intramuscularly) in a volume ranging between about 100 µl to about 10 ml containing concentrations of about $10^4$ to $10^{12}$ virus particles/ml. Preferably, the adenoviral vector is administered in a volume ranging between 0.1 and 2.0 ml. For example, the adenoviral vector can be administered with 100 µl, 500 µl, 1 ml, 2 ml. More preferably the adenoviral vector is administered in a volume of 0.5 ml. Optionally, the adenoviral vector can be administered in a concentration of about $10^7$ vp/ml, $10^8$ vp/ml, $10^9$ vp/ml, $10^{10}$ vp/ml, $5 \times 10^{10}$ vp/ml, $10^{11}$ vp/ml, or $10^{12}$ vp/ml. Typically, the adenoviral vector is administered in an amount of about $10^9$ to about $10^{12}$ viral particles (vp) to a human subject during one administration, more typically in an amount of about $10^{10}$ to about $10^{12}$ vp. The initial vaccination is followed by a boost as described above.

The initial vaccination can be followed by a boost or a kick from a vaccine/composition comprising the same adenoviral vector encoding an antigen or interest or a vaccine/composition comprising a different adenoviral vector encoding the same antigen of interest.

The composition can, if desired, be presented in a kit, pack or dispenser, which can contain one or more unit dosage forms containing the active ingredient. The kit, for example, can comprise metal or plastic foil, such as a blister pack. The kit, pack, or dispenser can be accompanied by instructions for administration.

The compositions of the invention can be administered alone or in combination with other treatments, either simultaneously or sequentially dependent upon the condition to be treated.

EMBODIMENTS

Embodiment 1 is an adenoviral vector comprising a nucleic acid sequence encoding a hexon polypeptide comprising a hexon hypervariable regions-encompassing polypeptide comprising an amino acid sequence selected from SEQ ID NO:1 or SEQ ID NO:2.

Embodiment 2 is the adenoviral vector of embodiment 1, wherein the hexon polypeptide sequence comprises SEQ ID NO:3 or SEQ ID NO:4.

Embodiment 3 is the adenoviral vector of embodiment 1 or 2, wherein the adenoviral vector further comprises an E1 deletion.

Embodiment 4 is the adenoviral vector of any one of embodiments 1-3, wherein the adenoviral vector further comprises an E3 deletion.

Embodiment 5 is the adenoviral vector of any one of embodiments 1-4, wherein the adenoviral vector further comprises a human adenovirus-5 (HAdV-5) E4 orf6.

Embodiment 6 is the adenoviral vector of any one of embodiments 1-5, wherein the adenoviral vector comprises a nucleic acid sequence selected from SEQ ID NO:5 or SEQ ID NO:6.

Embodiment 7 is the adenoviral vector of any one of embodiments 1-6, wherein the adenoviral vector further comprises at least one transgene.

Embodiment 8 is the adenoviral vector of any one of embodiments 1-7, wherein the transgene is located at the E1 deletion, at the E3 deletion, and/or adjacent to the right inverted terminal repeat (rITR).

Embodiment 9 is the adenoviral vector of any one of embodiments 1-8, wherein the adenoviral vector comprises one or more nucleic acid sequences from human adenovirus-26 (Ad26).

Embodiment 10 is a recombinant cell comprising the adenoviral vector of any one of embodiments 1-9.

Embodiment 11 is a method of producing an adenoviral vector, comprising: (a) growing the recombinant cell of embodiment 10 under conditions for production of the adenoviral vector; and (b) isolating the adenoviral vector from the recombinant cell.

Embodiment 12 is an immunogenic composition comprising the adenoviral vector of any one of embodiments 1-9 and a pharmaceutically acceptable carrier.

Embodiment 13 is a method of inducing an immune response in a subject in need thereof, the method comprising administering to the subject the immunogenic composition of embodiment 12.

Embodiment 14 is a method of producing an immunogenic composition, the method comprising combining an adenoviral vector according to any one of embodiments 1-9 with a pharmaceutically acceptable carrier.

EXAMPLES

Example 1: Design of Hexon-Chimeric Adenoviral Vectors Ad26HVRPtr1, Ad26HVRPtr12, and Ad26HVRPtr13

Described in this example are the designs of Ad26HVRPtr1, Ad26HVRPtr12, and Ad26HVRPtr13, which are new HAdV-26-based vectors carrying certain hexon sequence replacements obtained from chimpanzee adenoviruses. These hexon-chimeric adenoviral vectors were designed with the goal to generate possible new adenovirus-based (vaccine) vectors that are manufacturable, serologically distinct from HAdV-26 and against which there exists low (or no) preexisting immunity in human populations.

Ad26HVRPtr1, Ad26HVRPtr12, and Ad26HVRPtr13, comprising adenoviral vector genome sequences SEQ ID NO:4, SEQ ID NO:5, and SEQ ID NO:6, respectively, were designed as hexon-chimeric versions of the recombinant HAdV-26 vector described previously (WO2007104792 A2; Abbink et al., 2007). These vectors therefore were designed to carry the same E1 deletion, E3 deletion, and E4 orf6 replacement (by that of HAdV-5) as previously specified (WO2007104792 A2; Abbink et al., 2007).

Specific variants of the hexon-chimeric vectors generated and examined herein, as described in the following examples, are Ad26HVRPtr1.Fluc, Ad26HVRPtr12.Fluc, Ad26HVRPtr13.Fluc, Ad26HVRPtr12.RSVF-2A-GLuc, and Ad26HVRPtr13.RSVF-2A-GLuc, which comprise viral genome sequences SEQ ID NO:7, SEQ ID NO:8, SEQ ID NO:9, SEQ ID NO:10, and SEQ ID NO:11, respectively. As indicated in their vector names, these vectors were generated to carry, at the location of their E1 deletion, a CMV promoter-driven expression cassette encoding either firefly luciferase (FLuc) or the chimeric protein "RSV-$F_{A2}$-2A-GLuc" (RSVF-2A-GLuc), which is a fusion of respiratory syncytial virus strain A2 fusion glycoprotein (RSV-$F_{2A}$), a foot-and-mouth-disease virus 2A peptide, and *Gaussia* luciferase (GLuc). Both the FLuc and RSVF-2A-GLuc expression cassettes are driven by a CMV promoter and carry an SV40 polyadenylation signal. The cassette for RSVF-2A-GLuc further contains within its 5'untranslated region a sequence comprising intron 2 of the human Apolipoprotein A1 (ApoA1) gene.

Adenoviral vectors Ad26HVRPtr1, Ad26HVRPtr12, and Ad26HVRPtr13 (comprising SEQ ID NO:4, SEQ ID NO:5, and SEQ ID NO:6, respectively) were designed as hexon-chimeric in the sense that certain hexon gene segments within their HAdV-26-based genomes were replaced by corresponding hexon gene segments of other adenoviruses. The viruses that served as hexon sequence donors for Ad26HVRPtr1, Ad26HVRPtr12, and Ad26HVRPtr13 were, respectively, PtroAdV-1, PtroAdV-12, and PtroAdV-13. These viruses were identified in fecal samples of wild chimpanzees and have been allocated to human adenovirus species E (HAdV-E) (Wevers et al., J. Virol. 85(20):10774-84 (2011)). Partial hexon gene sequences of these viruses were publically provided under GenBank Accession numbers JN163971, JN163982, and JN163983, respectively. Considering that the acceptor vector for the hexon sequences is based on HAdV-26, i.e., a member of human adenovirus species D (HAdV-D), while the three hexon sequence donor viruses belong to HAdV-E, the vectors created herein represent cross-adenovirus species hexon-chimeric vectors.

The HAdV-26 hexon gene segments that were replaced herein to generate hexon-chimeric vectors Ad26HVRPtr1, Ad26HVRPtr12, and Ad26HVRPtr13 (and their derivatives constructed herein containing transgene expression cassettes) corresponded to nucleotides 18178 to 18357, 18379 to 18438, 18556 to 18633, 18685 to 18723, and 19027 to 19158 of the wild-type complete genome of HAdV-26 deposited under Genbank accession number EF153474 (version 1). These five HAdV-26 hexon gene segments, and their respective replacement segments derived from PtroAdV-1, PtroAdV-12, or PtroAdV-13, corresponded largely, but not entirely, to sequences encoding the hypervariable regions (HVRs). This is shown in FIG. 1A where the locations of the five segments as well as those of previously assigned HVRs are indicated within a schematic representation of the HAdV-26 hexon gene. Furthermore, in more detail this is illustrated by an amino acid alignment performed with (partial) hexon polypeptide sequences of HAdV-26, PtroAdV-1, PtroAdV-12, and PtroAdV-13 wherein the specific segments that were swapped herein are specifically highlighted alongside the previously assigned HVRs (FIG. 1B).

Of note, the five hexon gene segments of HAdV-26 that were replaced herein to generate Ad26HVRPtr1, Ad26HVRPtr12, and Ad26HVRPtr13 did not entirely correspond with the sequences comprising hexon HVRs that were replaced in previous reports describing hexon-chimeric, HAdV-5-based vectors (Roberts et al., Nature 441:239-43 (2006); Bradley et al., J Virol. 86:1267-72 (2012); Yu et al., Biochem Biophys Res Commun. 421:170-6 (2012); Bruder et al, PLoS One. 7(4):e33920 (2012)). For instance, as illustrated in FIGS. 1A and 1B, the five hexon gene segments failed to correspond fully to the seven amino acid stretches previously swapped to generate Ad5HVR48(1-7), a hexon chimeric vector based on HAdV-5 and comprising hexon HVRs of HAdV-48 (Roberts et al., Nature 441:239-43 (2006)).

The complete chimeric hexon gene nucleotide sequences of adenoviral vectors Ad26HVRPtr1, Ad26HVRPtr12, and Ad26HVRPtr13 are set forth in SEQ ID NO:13, SEQ ID NO:14, and SEQ ID NO:15, respectively. The complete chimeric hexon polypeptide sequences of these vectors are set for in SEQ ID NO:12, SEQ ID NO:3, and SEQ ID NO:4, respectively.

Figure 2A:
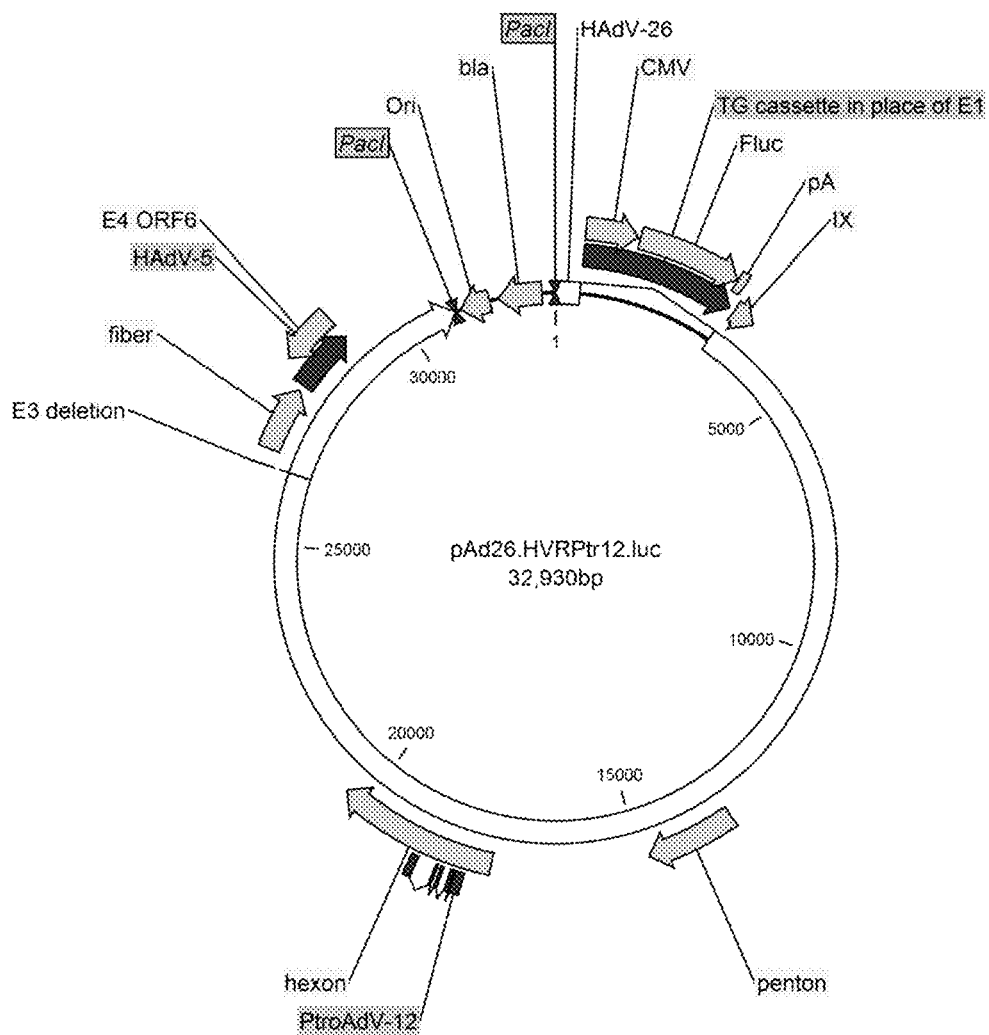
FIG. 2A-FIG. 2B show a schematic of the chimeric pAd26 vectors.
Figure 2B:
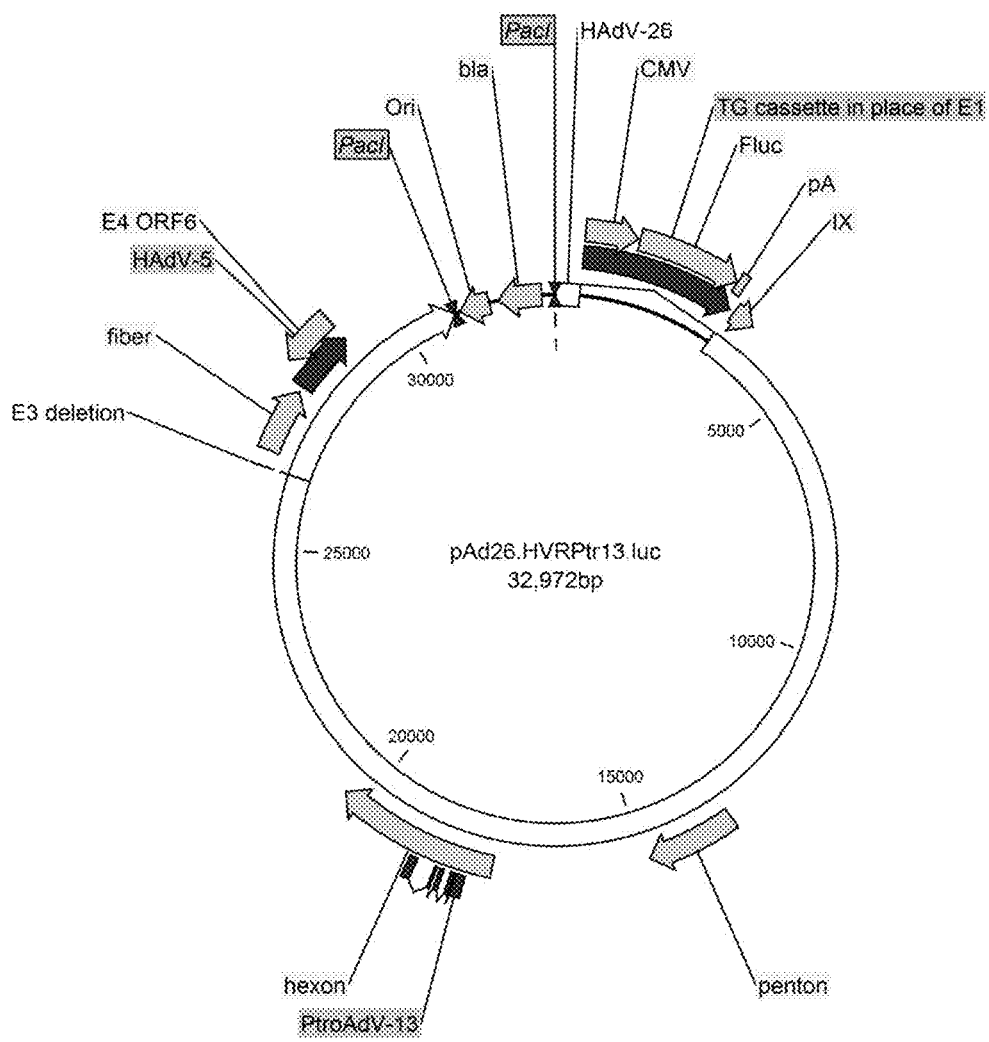

Example 2: Molecular Construction of Plasmids Carrying the Complete Adenoviral Vector Genomes of Ad26HVRPtr1.Fluc, Ad26HVRPtr12.Fluc and Ad26HVRPtr13.Fluc Ad26HVRPtr1, Ad26HVRPtr12, and Ad26HVRPtr13 vector genome-containing plasmids carrying a CMV promoter-driven FLuc expression cassette in the adenoviral E1 region were constructed using the same methods and strategy as described previously for the generation of the hexon-chimeric, Fluc-encoding vector "Ad26.HVR5C" (Ma et al., J. Canc. Res. Clin. Oncol. 141(3):419-29 (2015), supplementary FIG. 4). Briefly, the desired changes to the hexon gene were first introduced in the context of the intermediate, "hexon shuttle" plasmid pHex26-Shuttle.BamHI. This was done by standard gene synthesis and subcloning procedures (carried out by GeneArt (LifeTechnologies, Carlsbad, Calif.)) and resulted in modified hexon shuttle plasmids carrying the aforementioned chimeric hexon gene sequences set forth in SEQ ID NO:13, SEQ ID NO:14, and SEQ ID NO:15. Then, by homologous recombination in E. coli BJ5183 (Stratagene/Agilent Technologies, Santa Clara, Calif.), the chimeric hexon genes were shuttled from the hexon shuttle plasmids into pAd26.luc.dH, a plasmid that carries, between two Pad restriction sites, a hexon gene-deleted recombinant HAdV-26 vector genome equipped at the location of its E1 deletion with a CMV promoter-driven Fluc-encoding expression cassette. The above molecular cloning procedures resulted in the generation of plasmids pAd26.HVRPtr1.luc (SEQ ID NO:20), pAd26.HVRPtr12.luc (SEQ ID NO:21; FIG. 2A), and pAd26.HVRPtr13.luc (SEQ ID NO:22; FIG. 2B).

Three matching comparator hexon-chimeric adenoviral vector plasmids were also constructed in exactly the same manner as described above. In these plasmids, named pAd26.HVR5.luc (SEQ ID NO:17), pAd26.HVR35.luc (SEQ ID NO:18), and pAd26.HVR52.luc (SEQ ID NO:19), the aforementioned set of five HAdV-26 hexon gene segments was replaced by the corresponding sets of segments of HAdV-5, HAdV-35, and HAdV-52, respectively. These plasmids comprise the chimeric hexon gene nucleotide sequences set forth in SEQ ID NO:23, SEQ ID NO:24, and SEQ ID NO:25, respectively. These hexon genes encode the chimeric hexon polypeptide sequences set forth in SEQ ID NO:26, SEQ ID NO:27, and SEQ ID NO:28, respectively.

Example 3: Initial Assessment of Viability, Growth Efficiency, and Productivity of Adenoviral Vectors Ad26HVRPtr1.Fluc, Ad26HVRPtr12.Fluc, and Ad26HVRPtr13.Fluc Previous studies have shown that chimeric adenoviral vectors comprising cross-adenovirus species hexon sequences swaps often are non-viable or may display delayed growth kinetics and give lower yields (Youil et al., Hum. Gene Ther. 13:311-20 (2002); Wu et al. J Virol. 76:12775-82 (2002); Bradley et al., J Virol. 86:1267-72 (2012); Bruder et al., PLoS One. 7(4):e33920 (2012)). New hexon-chimeric adenoviral (vaccine) vectors should therefore be tested for basic growth properties, production yields, and particle quality.

The hexon-chimeric adenoviral vectors designed and constructed herein were assessed for viability, growth efficiency, productivity, and particle infectivity, comparing them with their parental HAdV-26-based vector. To this end, adenoviral vectors Ad26HVRPtr1.Fluc, Ad26HVRPtr12.Fluc, and Ad26HVRPtr13.Fluc, as well as comparator vectors Ad26HVR5.Fluc, Ad26HVR35.Fluc, and Ad26HVR52. Fluc were generated by transfection, according to standard procedures using Lipofectamine transfection reagent (Invitrogen; Carlsbad, Calif.), of the corresponding Ad vector genome plasmids described in Example 2 (i.e. pAd26.HVRPtr1.luc, pAd26.HVRPtr12.luc, pAd26.HVRPtr13.luc, pAd26.HVR5, pAd26.HVR35, and pAd26.HVR52, respectively) into E1-complementing PER.55K cells (Vogels et al., J Virol. 77:8263-71 (2003)) cultured in T25 flasks. Prior to the transfections, the Ad vector genome plasmids were digested with PacI to release the respective adenoviral vector genomes from the plasmid. The transfected cell cultures were monitored daily to register the day of onset of formation of the first viral plaque as well as the day at which total cytopathic effect (CPE) was reached (Table 1). At full CPE, infected cells and medium were collected and virus was released by three cycles of freeze-thawing. After harvesting of the viral rescue transfections, the viruses were further amplified by several successive infection rounds on the E1-complementing cell cultures. The viruses were then purified from crude viral harvests (by a two-step cesium chloride (CsCl) density gradient ultracentrifugation procedure) and viral particle (VP) and infectious unit titers (IU/mL) were subsequently determined, all by standard methods described previously (Alba R, Baker A H, Nicklin S A. Vector systems for prenatal gene therapy: principles of adenovirus design and production. Methods Mol Biol 2012; 891:55-84.:55-84).

Fluc, showed varying degrees of compromised productivity and/or infectivity. Ad26HVR52.Fluc was not viable at all (i.e. no viral plaques could be detected after viral DNA transfection), while the other three vectors were successfully rescued. Of these three, Ad26HVR5.Fluc and Ad26HVR35.Fluc clearly displayed delayed rescue and growth kinetics, while Ad26HVRPtr1.Fluc appeared to rescue and grow about as efficiently as the parental vector. Characterization of purified vector batches revealed that physical viral particle yields were especially impacted for Ad26HVR5.Fluc and Ad26HVRPtr1.Fluc, while particle infectivity appeared strongly compromised for all three of them (as indicated by the higher VP:IU ratio's seen for these vectors).

In conclusion, Ad26HVRPtr12 and Ad26HVRPtr13, which are hexon-chimeric vectors comprising cross-adenovirus species hexon sequence swaps, displayed good growth and production properties and are therefore considered promising candidates to serve as new vaccine vectors (from a manufacturability standpoint). Four other hexon-chimeric vectors, which were generated by using the same chimeric hexon design but using other adenoviruses as hexon sequence donor, showed less favorable properties.

Example 4: Generation of Adenoviral Vectors Ad26HVRPtr12.Fluc and Ad26HVRPtr13.Fluc This example describes the generation of the hexon-chimeric, Fluc-encoding adenoviral vectors used in the

TABLE 1

Rescue efficiencies, final production yields, and VP/IU ratio's observed for hexon-chimeric adenoviral vectors.

| Vector | HAdV species of the HVR donor | Virus rescue efficiency | | | Purified batch characterization | |
|---|---|---|---|---|---|---|
| | | Viral plaques formed | 1$^{st}$ viral plaque (days p.t.) | Total CPE (days p.t.) | Total Yield in 25 T150 flasks (VP) | VP to IU ratio |
| Ad26.FLuc | n.a. | Yes | 3-5 | 7-8 | $1.10 \times 10^{13}$ | 337 |
| Ad26HVR5.FLuc | C | Yes | 5 | 11 | $1.05 \times 10^{11}$ | 4000 |
| Ad26HVR35.FLuc | B | Yes | 5 | 12 | $1.75 \times 10^{12}$ | 829 |
| Ad26HVR52.FLuc | G | No | — | — | — | — |
| Ad26HVRPtr1.FLuc | E | Yes | 3 | 9 | $3.78 \times 10^{11}$ | 1029 |
| Ad26HVRPtr12.FLuc | E | Yes | 4 | 8 | $2.16 \times 10^{12}$ | 272 |
| Ad26HVRPtr13.FLuc | E | Yes | 3 | 7 | $1.07 \times 10^{13}$ | 150 | n.a., not applicable;
p.t., post transfection

Of the six chimeric vectors tested, only Ad26HVRPtr12.Fluc and Ad26HVRPtr13.Fluc gave results indicating that their capsid modifications did not compromise vector productivity and infectivity (Table 1). Viral rescue and growth efficiencies of these two vectors, as reflected by the time of onset of plaque formation and the time required to reach full CPE (after viral DNA transfection into E1-complementing cells), were within the range of those seen for the parental vector Ad26.Fluc. This was not the case for the other chimeric vectors tested except for Ad26HVRPtr1.Fluc. Furthermore, of all vectors tested, Ad26HVRPtr12.Fluc and Ad26HVRPtr13.Fluc gave the highest virus particle (VP) yields upon large-scale production and purification. Finally, while the other chimeric vectors all displayed VP:IU ratio's higher than that of parental Ad26.Fluc, Ad26HVRPtr12.Fluc and Ad26HVRPtr13.Fluc were found to have unaffected VP:IU ratio's.

The four other chimeric vectors, i.e. Ad26HVR5.Fluc, Ad26HVR35.Fluc, Ad26HVR52.Fluc, and Ad26HVRPtr1.

immunogenicity, seroprevalence, cross-neutralization, and manufacturability experiments described in Examples 6, 8, and 9.

Adenoviral vectors Ad26HVRPtr12.Fluc (also designated Ad26C4NVT005) and Ad26HVRPtr13.Fluc (also designated Ad26C3NVT005), which respectively comprise adenoviral vector genome sequences SEQ ID NO:8 and SEQ ID NO:9, were generated by transfection of the corresponding Ad vector genome plasmids (i.e. pAd26.HVRPtr12.luc and pAd26.HVRPtr13.luc, respectively) into E1-complementing PER.C6 cells. Prior to the transfection into PER.C6 cells, which were grown as adherent cell cultures in Dulbecco's modified Eagle's medium (DMEM) supplemented with 10% fetal bovine serum (FBS) and 10 mM MgCl$_2$, the Ad vector genome plasmids were digested with PacI to release the respective adenoviral vector genomes from the plasmid. The transfections were performed according to standard procedures using Lipofectamine transfection reagent (Invitrogen; Carlsbad, Calif.). After harvesting of the viral rescue transfections, the viruses were further amplified by several successive infection rounds on PER.C6 cell cultures. The viruses were purified from crude viral harvests using a two-step cesium chloride (CsCl) density gradient ultracentrifugation procedure as described before (Havenga et al., "Novel replication-incompetent adenoviral B-group vectors: high vector stability and yield in PER.C6 cells," J. Gen. Virol. 87(8):2135-43 (2006)). Viral particle (VP) titers were measured by a spectrophotometry-based procedure described previously (Maizel et al., "The polypeptides of adenovirus: I. Evidence for multiple protein components in the virion and a comparison of types 2, 7A, and 12," Virology, 36(1):115-25 (1968)).

Example 5: Generation of Adenoviral Vectors Ad26HVRPtr12.RSVF-2A-GLuc and Ad26HVRPtr13.RSVF-2A-GLuc This example describes the generation of the hexon-chimeric, RSVF-2A-GLuc-encoding adenoviral vectors used in the immunogenicity experiments described in Example 7.

Figure 3:
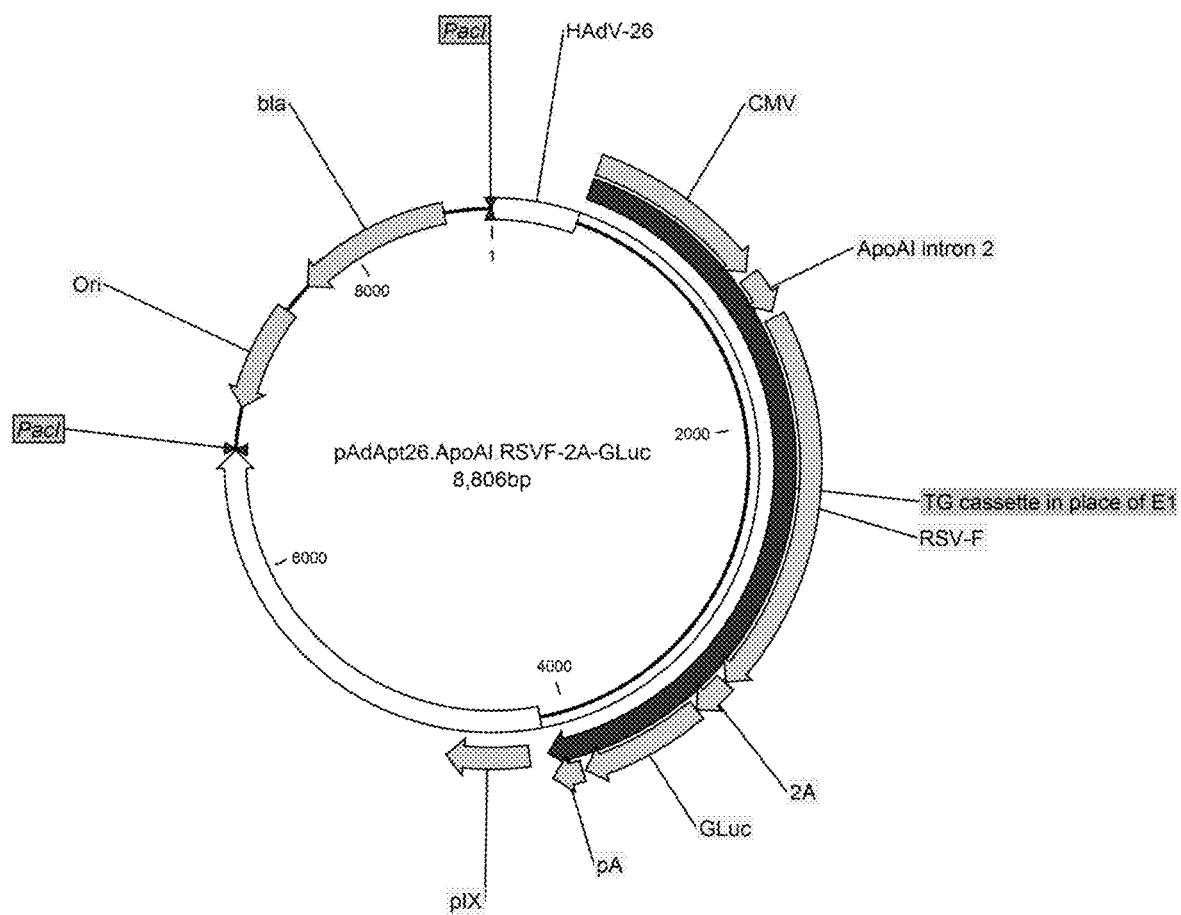
FIG. 3 shows a schematic of the general features of pAd26.ApoA1.RSVF-2A-GLuc (SEQ ID NO:29).

Generation of adenoviral vectors Ad26HVRPtr12.RSVF-2A-GLuc (also designated Ad26C4NVT001) and Ad26HVRPtr13.RSVF-2A-Gluc (also designated Ad26C3NVT001), which respectively comprise adenoviral vector genome sequences SEQ ID NO:10, and SEQ ID NO:11, involved the use of aforementioned plasmids pAd26.HVRPtr12.luc (SEQ ID NO:21; FIG. 2A) and pAd26.HVRPtr13.luc (SEQ ID NO:22; FIG. 2b), respectively, as well as plasmid pAdApt26.ApoAI.RSVF-2A-GLuc (SEQ ID NO:29; FIG. 3).

pAdApt26.ApoAI.RSVF-2A-GLuc is a plasmid harboring a left-end genome fragment of the E1-deleted HAdV-26-based vector described previously (WO2007104792 A2; Abbink et al., 2007) that further contains, at the location of the adenoviral E1 deletion, the aforementioned transgene expression cassette encoding "RSV-$F_{42}$-2A-GLuc" (RSVF-2A-GLuc). pAdApt26.ApoAI.RSVF-2A-GLuc was constructed by several standard gene synthesis and molecular cloning steps that together amounted to creation of said RSVF-2A-GLuc cassette and its insertion into pAdApt26, a previously described plasmid harboring said left-end Ad vector genome fragment (WO2007104792 A2; Abbink et al., 2007).

Figure 4:
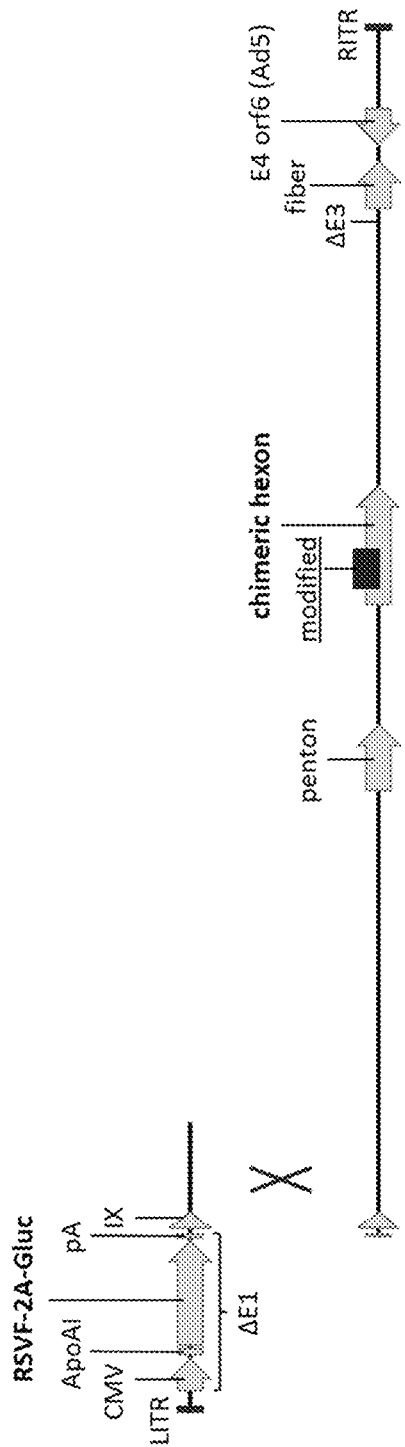
FIG. 4 shows a schematic of the homologous recombination strategy that was used to generate adenoviral vectors Ad26HVRPtr12.RSVF-2A-GLuc and Ad26HVRPtr13.RSVF-2A-GLuc (in E1-complementing cells).

Adenoviral vectors Ad26HVRPtr12.RSVF-2A-GLuc and Ad26HVRPtr13.RSVF-2A-GLuc were generated as follows. Plasmids pAd26.HVRPtr12.luc and pAd26.HVRPtr13.luc were digested by restriction enzymes PacI and PsiI in order to release from these plasmids a certain 28-kb, left end-deleted adenoviral vector genome fragment comprising the chimeric hexon sequence. The resulting respective digestion products were each separately co-transfected with PacI-digested pAdApt26.ApoAI.RSVF-2A-GLuc into E1-complementing PER.C6 to allow for rescue of the respective hexon-chimeric, RSVF-2A-Gluc-encoding viruses via homologous recombination between overlapping vector genome restriction fragments as illustrated in FIG. 4. In this strategy, homologous recombination occurs at a 2.7-kb region of overlap region between a 6.7-kb PacI-PacI restriction fragment of pAdApt26.ApoAI.RSVF-2A-GLuc (FIG. 4, top) and a 28-kb PsiI-PacI restriction fragment of pAd26.HVRPtr12.luc or pAd26.HVRPtr13.luc (FIG. 4, bottom). The transfections were performed according to standard procedures using Lipofectamine transfection reagent (Invitrogen; Carlsbad, Calif.). Single isolated plaques of the two rescued viruses, Ad26HVRPtr12.RSVF-2A-GLuc and Ad26HVRPtr13.RSVF-2A-Gluc, were further propagated on PER.C6 cells and subsequently purified and titered as described herein for vectors Ad26HVRPtr12.FLuc and Ad26HVRPtr13.Fluc in Example 4).

Cellular and Humoral Immune Responses Induced by Novel Adenoviral Vector

Examples 6 and 7 describe experiments performed to assess the immunogenicity of the novel Ad26HVRPtr12 and Ad26HVRPtr13 vectors generated herein. In these experiments, the novel vectors were assessed for their abilities to induce humoral and cellular immune responses against vector-encoded (model) antigens in mice after intramuscular immunization. The vectors were tested using two different antigens: Firefly luciferase (FLuc) and RSV-$F_{42}$-2A-GLuc (RSVF-2A-GLuc). RSVF-2A-GLuc is a chimeric protein composed of the respiratory syncytial virus strain A2 fusion glycoprotein, a foot-and-mouth-disease virus 2A peptide, and Gaussia luciferase (GLuc). Each vector was compared side-by-side with a benchmark vector based on human adenovirus type 26 (HAdV-26, also referred to herein as Ad26) carrying the same antigen-encoding transgene cassette. Immune responses against the respective antigens were measured using well-known immunological assays, such as enzyme-linked immunospot assay (ELISPOT), enzyme-linked immunosorbent assay (ELISA), and, in case of the RSVF-2A-GLuc antigen, a respiratory syncytial virus neutralization assay (VNA).

Figure 5A:
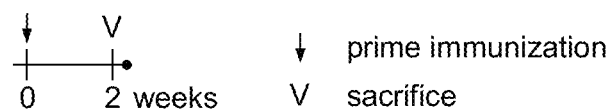
FIG. 5A-FIG. 5B show the cellular and humoral immune responses induced by Ad26HVRPtr12.FLuc and Ad26HVRPtr13.FLuc.
Figure 5B:
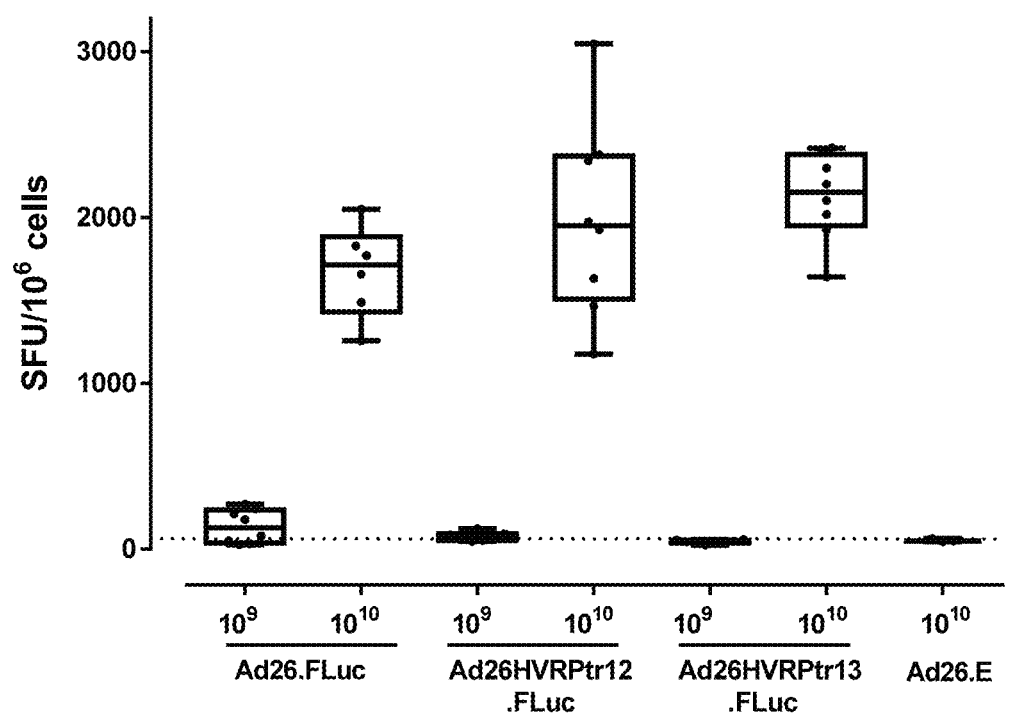

Example 6: Cellular Immune Responses Induced by Ad26HVRPtr12.FLuc and Ad26HVRPtr13.FLuc To evaluate the cellular immunogenicity of novel adenoviral vectors Ad26HVRPtr12 and Ad26HVRPtr13, Balb/C mice were immunized intramuscularly with Ad26.FLuc (positive control), Ad26HVRPtr12 and Ad26HVRPtr13 vectors expressing FLuc (i.e. Ad26HVRPtr12.FLuc and Ad26HVRPtr13.FLuc), or with an adenovector not encoding FLuc, Ad26 empty. The FLuc-expressing vectors were tested at $10^9$ and $10^{10}$ viral particles (vp) per mouse and the Ad26 empty vector was administered at $10^{10}$ vp. Two weeks post-immunization mice were sacrificed and splenocytes were isolated (FIG. 5A). Cellular immune responses were determined by ex-vivo ELISPOT assay measuring the relative number of IFN-γ-secreting cells after overnight splenocyte stimulation with a 15 mer overlapping FLuc peptide pool (FIG. 5B). The results show that at the higher-dose immunization ($10^{10}$), the cellular immune responses induced by the Ad26HVRPtr12 and Ad26HVRPtr13 vectors were in the same range or higher than the response seen for Ad26.Fluc.

Overall, the cellular immune responses induced by the FLuc-expressing recombinant Ad26HVRPtr12 and Ad26HVRPtr13 adenoviral vectors of the invention clearly indicate potent immunogenicity of these vectors in mice.

Figure 6A:
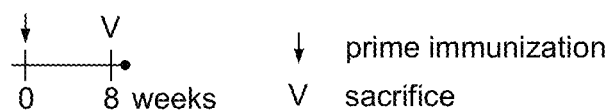
FIG. 6A-FIG. 6D show cellular and humoral immune responses induced by Ad26HVRPtr12.RSVF-2A-GLuc and Ad26HVRPtr13.RSVF-2A-GLuc.

Example 7: Cellular and Humoral Immune Responses Induced by Ad26HVRPtr12.RSVF-2A-GLuc and Ad26HVRPtr13.RSVF-2A-GLuc The immunogenicity of novel Ad26HVRPtr12 and Ad26HVRPtr13 adenoviral vectors was further evaluated using RSV-$F_{42}$-2A-GLuc (RSVF-2A-GLuc) as a vector-encoded (model) vaccine antigen. Balb/C mice were immunized intramuscularly with Ad26.RSVF-2A-GLuc (positive control), Ad26HVRPtr12.RSVF-2A-GLuc, or Ad26HVRPtr13.RSVF-2A-GLuc at three different concentrations (each at $10^8$ vp, $10^9$ vp, or $10^{10}$ vp per mouse), or with Ad26.FLuc, Ad26HVRPtr12.FLuc, or Ad26HVRPtr13.FLuc at $10^{10}$ vp per mouse). Eight weeks post-immunization, mice were sacrificed and blood samples and splenocytes were collected (FIG. 6A). Different immune parameters were assessed as described below.

Figure 6B:
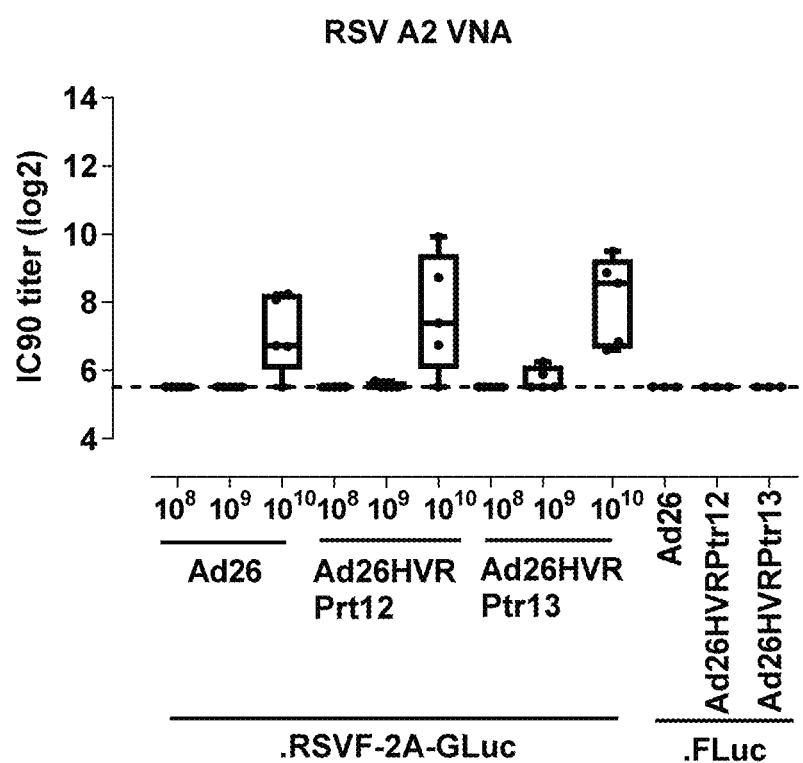

A virus neutralization assay (VNA) was performed in order to assess the capacity of Ad26HVRPtr12.RSVF-2A-GLuc and Ad26HVRPtr13.RSVF-2A-GLuc to elicit respiratory syncytial virus-neutralizing-antibodies. FIG. 6B depicts the respiratory syncytial virus strain A2 (RSV A2) VNA titers measured for sera samples collected eight weeks after immunization. Each dot represents one mouse; the bars represent the group mean and the dotted line corresponds to the lower limit of quantification (LLOQ=6.88; mean endpoint titer of linearity samples). The results show that the $10^{10}$ vp-dose immunizations with Ad26HVRPtr12.RSVF-2A-GLuc and Ad26HVRPtr13.RSVF-2A-GLuc gave rise to similar RSV A2 neutralization titers as those found for the benchmark Ad26 vector encoding the same antigen. Titers induced by all three vectors, Ad26, Ad26HVRPtr12 and Ad26HVRPtr13 encoding RSVF-2A-GLuc, were detected mainly at the highest dose used for immunization, $10^{10}$ vp. As expected, no RSV A2-specific responses were detected against the respective adenovectors encoding Firefly luciferase.

Figure 6C:
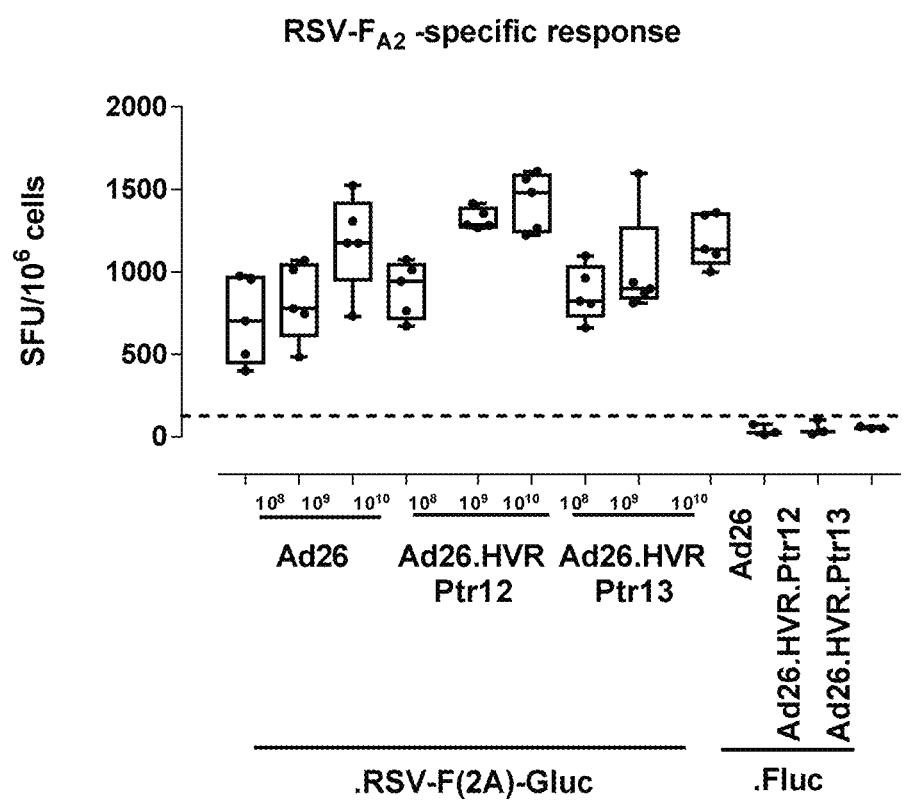

Induction of cellular immunity against the vector-encoded antigen was evaluated by an RSV-$F_{A2}$-specific ELISPOT assay. To this end, eight weeks after immunization, splenocytes from immunized mice were isolated and stimulated overnight with 15 mer overlapping peptides spanning the RSV-$F_{A2}$ protein and cellular immune responses were determined by ex-vivo ELISPOT assay measuring the relative number of IFN-$\gamma$-secreting cells. The data show that the antigen-specific cellular immune responses elicited by the novel vectors Ad26HVRPtr12 and Ad26HVRPtr13 encoding RSVF-2A-GLuc were dose-dependent and, per dose, respectively higher and similar in magnitude to those induced by the benchmark vector, Ad26.RSVF-2A-GLuc (FIG. 6C). As expected, no RSVF-$F_{A2}$-specific responses were measured from splenocytes of mice immunized with adenovectors encoding Firefly luciferase.

Figure 6D:
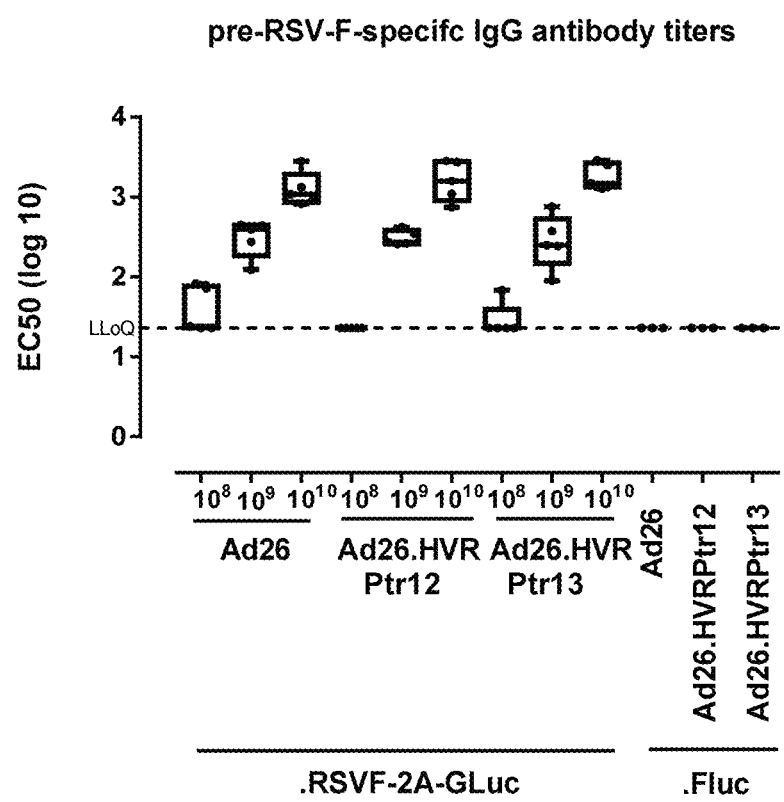

The ability of the RSVF-2A-GLuc-expressing vectors to elicit RSV-$F_{A2}$-specific IgG antibodies was assessed by ELISA. Sera collected 8 weeks post-immunization from the mice immunized with Ad26 (positive control), Ad26HVRPtr12, Ad26HVRPtr13 expressing RSVF-2A-GLuc transgene or Firefly luciferase (control) were tested in an anti-RSV $F_{A2}$ IgG antibody ELISA. Specifically, this ELISA detects IgG antibodies capable of binding to a recombinant stable pre-fusion RSV-$F_{A2}$ protein (pre-RSV-F). The results show that Ad26HVRPtr12.RSVF-2A-GLuc and Ad26HVRPtr13.RSVF-2A-GLuc dose-dependently elicited similar pre-RSV-F-specific IgG antibody titers as those induced by Ad26.RSVF-2A-GLuc (FIG. 6D). As expected, no RSV-$F_{A2}$-specific antibody titers were detected in sera from mice immunized with vectors encoding Firefly luciferase only. The graph depicts IgG ELISA titers calculated as endpoint titers ($\log_{10}$). Each dot represents one mouse; the bars represent the group mean and dotted line the lower limit of quantification (LLOQ) calculated as 1.36 $\log_{10}$).

Altogether, the data show that the novel Ad26HVRPtr12 and Ad26HVRPtr13 adenoviral vectors induced potent cellular and humoral immune responses against the encoded antigens, similar in magnitude to or higher than those induced by the benchmark vector based on HAdV-26. These immune responses clearly indicate potent immunogenicity of the Ad26HVRPtr12 and Ad26HVRPtr13 adenoviral vectors in mice.

Example 8: Evaluation of Serological Cross-Neutralization Among Novel and Existing Adenoviral Vectors For their potential utility as new adenoviral vaccine vectors, the novel Ad26HVRPtr12 and Ad26HVRPtr13 adenoviral vectors created herein would preferably be serologically distinct from existing adenoviral vectors currently already in development as vaccine vectors, such as vectors based on human adenovirus serotypes HAdV-5 and HAdV-35. Therefore, cross-neutralization tests were performed among the novel Ad26HVRPtr12 and Ad26HVRPtr13 adenoviral vectors and several existing vectors based on HAdV-4, HAdV-5, HAdV-26 and HAdV-35. To this end, mice antisera, each raised against one of these adenoviral vectors, were tested against each of the different vectors in an adenovirus neutralization assay. The mice antisera used for this assay were collected from Balb/C mice, two or eight weeks after their immunization with $10^{10}$ vector particles per mouse. The adenovirus neutralization assay was carried out as described previously (Spangers et al 2003. J. Clin. Microbiol. 41:5046-5052). Briefly, starting from a 1:16 dilution, the sera were 2-fold serially diluted, then pre-mixed with the adenoviral vectors expressing firefly luciferase (FLuc), and subsequently incubated overnight with A549 cells (at multiplicity of infection of 500 virus particles per cell). Luciferase activity levels in infected cell lysates measured 24 hours post-infection represented vector infection efficiencies. Neutralization titers against a given vector were defined as the highest serum dilution capable of giving a 90% reduction of vector infection efficiency. The neutralization titers were arbitrarily divided into the following categories: <16 (no neutralization), 16 to 200, 200 to 2,000, and >2,000.

Figure 7:
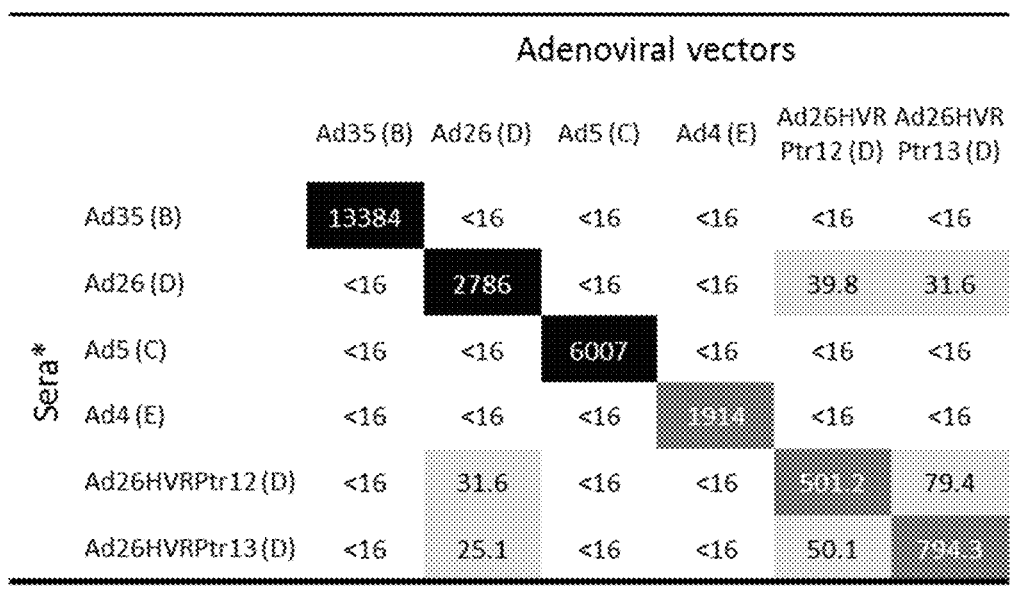
FIG. 7 shows homologous and heterologous adenovirus neutralization titers induced in mice immunized with adenoviral vectors Ad35, Ad26, Ad5, Ad4, Ad26HVRPtr12, and Ad26HVRPtr13.

The results show no or very low levels of cross-neutralization among the vectors tested (FIG. 7). Slight cross-neutralization was observed for Ad26HVRPtr12 towards Ad26 and Ad26HVRPtr13 vectors; and for Ad26HVRPtr13 towards Ad26 and Ad26HVRPtr12 vectors. The reciprocal cross-neutralization titers seen for these vectors were considerably lower than the respective homologous neutralization titers obtained for these same vectors. Importantly, the novel Ad26HVRPtr12 and Ad26HVRPtr13 vectors did not display cross-neutralization with the human adenoviral vectors included in the tested panel, i.e. Ad35, Ad5 and Ad4, except for Ad26 for which cross neutralization was observed at a very low level. Therefore, the new adenoviral vectors Ad26HVRPtr12 and Ad26HVRPtr13 could each potentially be used in combination with one or more of these or other distinct adenoviral vectors in sequential immunizations, for example in the context of a heterologous prime-boost vaccination regimen or, alternatively or additionally, in the context of a series of two or more consecutive vaccination regimens against different diseases or antigens.

Example 9: Seroprevalence of Novel Adenoviral Vectors in Human Populations

Important for their potential use as efficacious vaccine vectors is that the novel adenoviral vectors described herein are not hampered by high levels of pre-existing anti-vector humoral immunity in vaccine target populations. Therefore, the Ad26HVRPtr12 and Ad26HVRPtr13 vectors were each evaluated for their seroprevalence within 200 human cohort serum samples from adults, ages 18 to 55 years, living in the United States (US) and the European Union (EU). The vectors were tested for neutralization by the human serum samples by performing a standard adenovirus neutralization assay as carried out in Example 7 and described previously (Spangers et al 2003. J. Clin. Microbiol. 41:5046-5052). Briefly, starting from a 1:16 dilution, the sera were 2-fold serially diluted, then pre-mixed with the adenoviral vectors expressing firefly luciferase (FLuc), and subsequently incubated overnight with A549 cells (at a multiplicity of infection of 500 virus particles per cell). Luciferase activity levels in infected cell lysates, measured 24 hours post-infection, represented vector infection efficiencies. Neutralization titers against a given vector were defined as the highest serum dilution capable of giving a 90% reduction of vector infection efficiency. The neutralization titers were arbitrarily divided into the following categories: <16 (no neutralization), 16 to 300, 300 to 1000, 1000 to 4000 and >4000.

Figure 8:
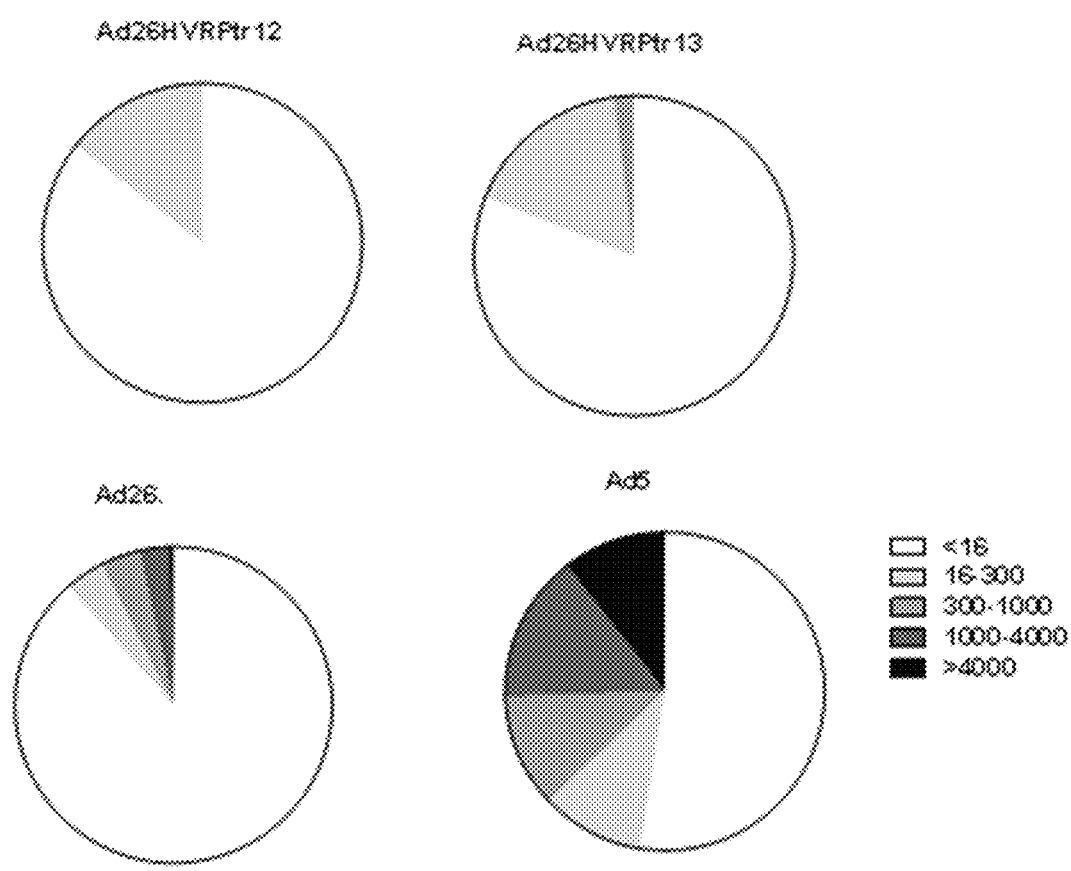
FIG. 8 shows the seroprevalence of Ad26, Ad5, Ad26HVRPtr12 and Ad26HVRPtr13 in 200 human cohort serum samples from adults, age 18 to 55 years, living in the United States (US) and European Union (EU). Neutralization titers measured in these sera against each vector were divided into four categories (<16 (no neutralization), 16 to 300, 300 to 1,000, 1000 to 4000 and >4000), represented in the charts as indicated.

The results indicate that adenoviral vectors Ad26HVRPtr12 and Ad26HVRPtr13 have a considerably lower seroprevalence in the human subjects studied than the control Ad5 vector, and a similar seroprevalence in these subjects as the benchmark Ad26 vector (FIG. 8). Furthermore, the positive neutralization titers that were seen against the novel Ad26HVRPtr12 and Ad26HVRPtr13 vectors were generally quite low, mostly not higher than 300. By contrast, most of the positive neutralization titers found against both Ad26 and Ad5 were higher than 300.

Altogether, the above data indicate that pre-existing humoral anti-vector immunity against Ad26HVRPtr12 and Ad26HVRPtr13 vectors can be considered to be low in the evaluated vaccine target populations, suggesting that these vectors have potential as efficacious vaccine vectors in these populations.

Example 10: Adenoviral Vector Productivity in Suspension PER.C6 Cells

Adenovirus vectors to be used in clinical trials and beyond need to be readily producible to high titers in a scalable, serum-free adenovirus production platform. Suspension-adapted PER.C6® cells, also referred to herein as suspension PER.C6 cells or sPER.C6, represent such a platform as they have been shown to support large-scale manufacturing of adenoviral vectors in bioreactors, achieving large quantities of high-titer, clinical grade vector preparations, e.g. of E1-deleted vectors based on HAdV-26 or HAdV-35 (EP 2536829 B1, EP 2350268 B1).

As an initial assessment as to whether the novel vectors described herein would fit sPER.C6 cell-based production processes, small-scale vector productivity experiments were performed on sPER.C6 cells cultured in shaker flasks. These productivity experiments were carried out using the Fluc-encoding versions of the novel chimeric vectors Ad26HVRPtr12 and Ad26HVRPtr13 (described in Example 4). Taken along as a benchmark control was the HAdV-26-based vector Ad26.Fluc. Suspension PER.C6 cell cultures, seeded into shaker flasks at a density of $1\times10^6$ cells/ml in a total volume of 10 ml of PERMEXCIS® medium (available from Lonza) supplemented with 4 mM L-Glutamine (Lonza), were infected with the different vectors at different virus particle (VP)-to-cell ratios and then incubated for 4 days. The different VP-to-cell ratios used for infection were 70, 150 and 900. Samples of the infected cell cultures were taken every day and VP titers were determined in these samples by a quantitative PCR (qPCR)-based protocol that employs primers and probe that are specific for the CMV promoter (which is present in all the vectors tested). This protocol entails a DNAse treatment of the test samples prior to the qPCR to remove any free vector DNA (i.e. vector genomes that are not packaged into viral particles).

Figure 9:
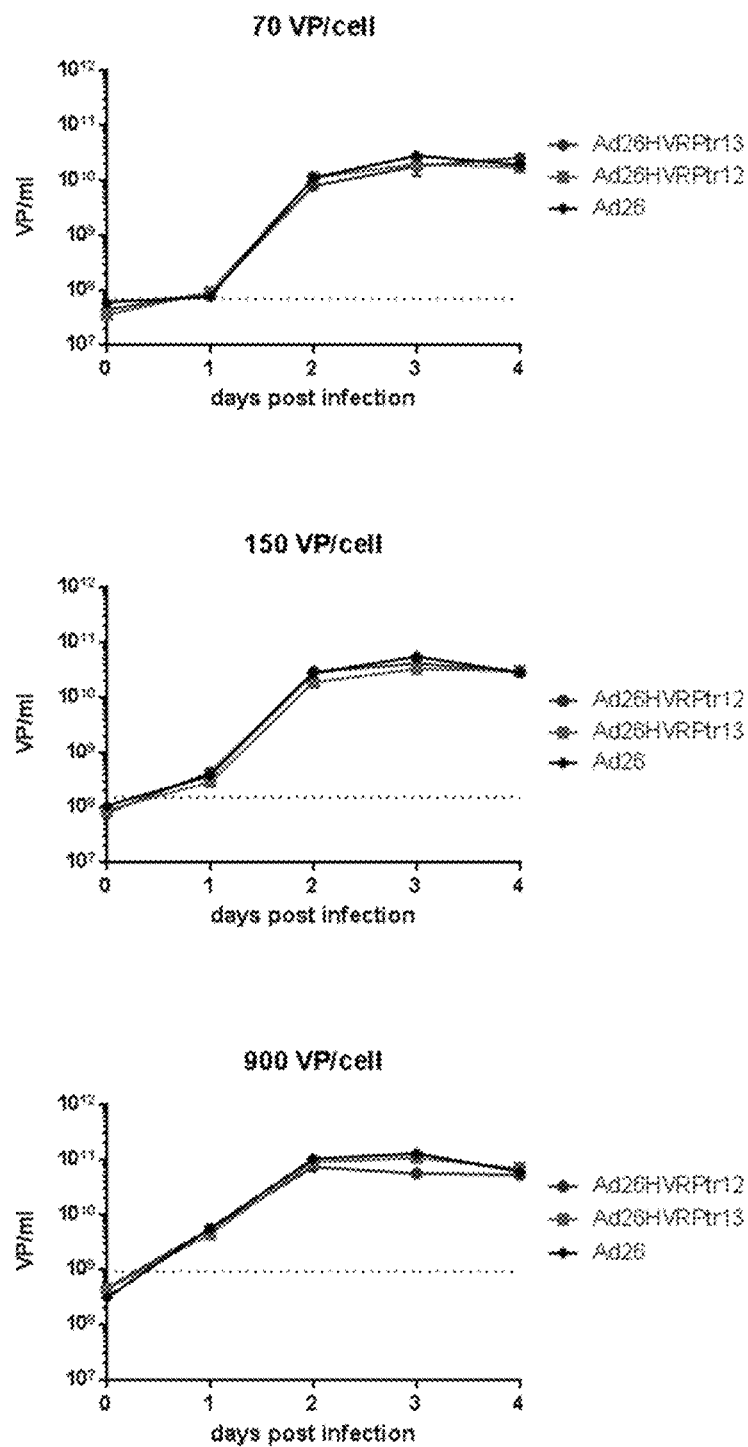
FIG. 9 shows productivity of novel capsid-chimeric vectors AdHVRPtr12.FLuc and Ad26HVRPtr13.FLuc in production cell line sPER.C6.

The productivity results obtained for chimeric vectors Ad26HVRPtr12.FLuc and Ad26HVRPtr13.FLuc are shown in FIG. 9. The two chimeric vectors yielded VP titers that were equivalent to those obtained to the parental benchmark vector Ad26.Fluc. These results thus demonstrate good productivity of each of the novel chimeric vectors on a sPER.C6-based, serum-free suspension cell culture model.

Collectively, the studies of humoral and cellular immune responses to the novel recombinant adenoviral vectors of the invention, as presented above, clearly indicate potent immunogenicity of these vectors in mice. In addition, the vectors demonstrated to induce no or very low cross-neutralizing antibody responses against certain existing adenoviral vaccine vector candidates (e.g. Ad26 and Ad35) or vice versa, as well as only very low cross-neutralizing antibody responses against each other. Furthermore, the new vectors showed low seroprevalence in humans. Finally, the new vectors can be readily produced at high yields. The combination of low seroprevalence, potent immunogenicity and producibility suggests that the novel adenoviral vectors of the invention can be useful as novel vaccine vector candidates against a variety of pathogens and may additionally have utility in gene therapy and/or diagnostics.

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

SEQUENCE LISTING (29 sequences)

SEQ ID NO: 1 - protein, 303 aa, Artificial Sequence
  Ad26HVRPtr12 hexon HVRs
PSQWEQNETNVNKTHTFGMAAMKGEAIDKNGLQIGTDAADQDKPIYADKTFQPEPQVGEEDWIDKADFYGGRALKKDTKMKPCYGSFARPTNEKGGQAKFKPVNEGEQPKDLDIDMNFFDPTTINTPDVVLYTENVNLETPDTHVVYKAGTSDDSSEVNLAQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLDGVGTNTAYQGVKVKTTNGNDTWEKDETVYEFNQIGKGDIY

SEQ ID NO: 2 - protein, 317 aa, Artificial Sequence
  Ad26HVRPtr13 hexon HVRs
SSQWEQAKPGNGGTMETHTYGVAPMGGENITKDGLQIGTDATADQNKPIYADKTFQPEPQVGEENWQETESFYGGRALKKDTKMKPCYGSFARPTNEKGGQAKFKPVNEGEQPKDLDIDLAFFDTPGGTVNGQDEYKADIVMYTENVNLETPDTHVVYKPGKEDASSEINLVQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLDGSGTNAAYQGVKVKNGEDGDLESEWENDDTVAARNQICKGNIF

SEQ ID NO: 3 - protein, 928 aa, Artificial Sequence
  Ad26HVRPtr12 hexon
MATPSMMPQWAYMHIAGQDASEYLSPGLVQFARATDTYFSLGNKFRNPTVAPTHDVTTDRSQRLTLRFVPVDREDTTYSYKARFTLAVGDNRVLDMASTYFDIRGVLDRGPSFKPYSGTAYNSLAPKGAPNPSQWEQNETNVNKTHTFGMAAMKGEAIDKNGLQIGTDAADQDKPIYADKTFQPEPQVGEEDWIDKADFYGGRALKKDTKMKPCYGSFARPTNEKGGQAKFKPVNEGEQPKDLDIDMNFFDPTTINTPDVVLYTENVNLETPDTHVVYKAGTSDDSSEVNLAQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLDGVGTNTAYQGVKVKTTNGNDTWEKDETVYEFNQIGKGDIYAMEINLQANLWKSFLYSNVALYLPDSYKYTPANVKLPANTNTYEYMNGRVVAPSLVDAYINIGARWSLDPMDNVNPFNHHRNAGLRYRSMLLGNGRYVPFHIQVPQKFFAIKNLLLLPGSYTYEWNFRKDVNMILQSSLGNDLRVDGASVRFDSVNLYATFFPMAHNTASTLEAMLRNDTNDQSFNDYLSAANMLYPIPAKATNVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQCNMTKDWFLVQMLSHYNIGYQGFHVPEGYKDRMYSFFRNFQPMSRQVVDEINYKDYKAVTLPFQHNNSGFTGYLAPTMRQGQPYPANFPYPLIGQTAVPSVTQKKFLCDRVMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 4 - protein, 942 aa, Artificial Sequence
  Ad26HVRPtr13 hexon
MATPSMMPQWAYMHIAGQDASEYLSPGLVQFARATDTYFSLGNKFRNPTVAPTHDVTTDRSQRLTLRFVPVDREDTTYSYKARFTLAVGDNRVLDMASTYFDIRGVLDRGPSFKPYSGTAYNSLAPKGAPNSSQWEQAKPGNGGTMETHTYGVAPMGGENITKDGLQIGTDATADQNKPIYADKTFQPEPQVGEENWQETESFYGGRALKKDTKMKPCYGSFARPTNEKGGQAKFKPVNEGEQPKDLDIDLAFFDTPGGTVNGQDEYKADIVMYTENVNLETPDTHVVYKPGKEDASSEINLVQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLDGSGTNAAYQGVKVKNGEDGDLESEWENDDTVAARNQICKGNIFAMEINLQANLWKSFLYSNVALYLPDSYKYTPANVKLPANTNTYEYMNGRVVAPSLVDAYINIGARWSLDPMDNVNPFNHHRNAGLRYRSMLLGNGRYVPFHIQVPQKFFAIKNLLLLPGSYTYEWNFRKDVNMILQSSLGNDLRVDGASVRFDSVNLYATFFPMAHNTASTLEAMLRNDTNDQSFNDYLSAANMLYPIPAKATNVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQCNMTKDWFLVQMLSHYNIGYQGFHVPEGYKDRMYSFFRNFQPMSRQVVDEINYKDYKAVTLPFQHNNSGFTGYLAPTMRQGQPYPANFPYPLIGQTAVPSVTQKKFLCDRVMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 5 - DNA, 28263 bp, Artificial Sequence
  Ad26HVRPtr12
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgaaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagccagtgggagcaaaatgaaaccaatgttaataaaacacacacctttgggatggcagccatgaaaggagaagctattgacaaaaatggtctgcaaattggaactgacgcggcggatcaggataaaccaatttatgcagataaaactttccagccagaacctcaagtaggagaggaagactggattgataaagcagatttctatggcggaagagctcttaaaaaagacactaaaatgaaaccatgctatggatcttttgctagacctactaatgagaaaggaggtcaggcaaagttcaaaccagttaatgaaggagaacaacctaaagatctggatatagatatgaacttctttgacccaaccactattaacacaccagatgtagtgctgtacactgaaaatgttaatcttgaaacaccagacactcatgtggtttacaaggcaggaacttcagatgacagttctgaggtcaatttggctcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggtgtgggcactaatactgcataccaaggcgttaaagttaagacaactaatggaaacgacacgtgggaaaaagatgaaactgtttatgagtttaatcaaattggcaagggggatatctatgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 6 - DNA, 28305 bp, Artificial Sequence
  Ad26HVRPtr13
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgaaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaactttccagccagaacctcaagtaggagaagaaaattggcaagaaactgaaagcttttatggtggtagggctcttaaaaaagacactaaaatgaaaccatgctatggatcttttgctagacctactaatgagaaaggaggtcaggcaaagttcaaaccagttaatgaaggagaacaacctaaagatctggatatagatctggctttctttgatactcccggtggcactgtgaatggccaagatgagtataaagcagacattgtcatgtacactgaaaatgttaatcttgaaacaccagacactcatgtggtttacaagccaggcaaggaagatgcaagttctgaaattaacctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 7 - DNA, 30964 bp, Artificial Sequence
  Ad26.HVRPtr1.FLuc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaaactttccagccagaacctcaaataggggaagagtcatggactgatactgacggaaccaatgaaaaattcggaggaagagtccttaaaaaggacactaaaatgaaaccatgctatggatcttttgctagacctactaatgagaaaggaggtcaggcaaagttcaaaccagttaatgaaggagaacaacctaaagatctggatatagatatgaacttttttgatggtagagatgcagctgctaactttactccagaagtagtgttgtacactgaaaatgttaatcttgaaacaccagacactcatgtggtttacaagccaggaacctcagatgtgagttcccatgtcaatttgggtcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggacgctgtgggtattactaaaacttatcaaggtatcaaaacgcaaaatggtcaaactacaacgtgggaaaaggacaccagtgttagtacggccaatgaaataggcattggcaacaatcttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 8 - protein, 30940 aa, Artificial Sequence
  Ad26.HVRPtr12.FLuc
CATCATCAATAATATACCCCACAAAGTAAACAAAAGTTAATATGCAAATGAGCTTTTGAATTTTAACGGTTTTGGGGCGGAGCCAACGCTGATTGGACGAGAAACGGTGATGCAAATGACGTCACGACGCACGGCTAACGGTCGCCGCGGAGGCGTGGCCTAGCCCGGAAGCAAGTCGCGGGGCTGATGACGTATAAAAAAGCGGACTTTAGACCCGGAAACGGCCGATTTTCCCGCGGCCACGCCCGGATATGAGGTAATTCTGGGCGGATGCAAGTGAAATTAGGTCATTTTGGCGCGAAAACTGAATGAGGAAGTGAAAAGCGAAAAATACCGGTCCCTCCCAGGGCGGAATATTTACCGAGGGCCGAGAGACTTTGACCGATTACGTGGGGGTTTCGATTGCGGTGTTTTTTTCGCGAATTTCCGCGTCCGTGTCAAAGTCCGGTGTTTATGTCACAGATCAGCTGACCTAGGTGGTCAATATTGGCCATTAGCCATATTATTCATTGGTTATATAGCATAAATCAATATTGGCTATTGGCCATTGCATACGTTGTATCCATATCATAATATGTACATTTATATTGGCTCATGTCCAACATTACCGCCATGTTGACATTGATTATTGATTAGTTATTAATAGTAATCAATTACGGGGTCATTAGTTCATAGCCCATATATGGAGTTCCGCGTTACATAACTTACGGTAAATGGCCCGCCTGGCTGACCGCCCAACGACCCCCGCCCATTGACGTCAATAATGACGTATGTTCCCATAGTAACGCCAATAGGGACTTTCCATTGACGTCAATGGGTGGAGTATTTACGGTAAACTGCCCACTTGGCAGTACATCAAGTGTATCATATGCCAAGTACGCCCCCTATTGACGTCAATGACGGTAAATGGCCCGCCTGGCATTATGCCCAGTACATGACCTTATGGGACTTTCCTACTTGGCAGTACATCTACGTATTAGTCATCGCTATTACCATGGTGATGCGGTTTTGGCAGTACATCAATGGGCGTGGATAGCGGTTTGACTCACGGGGATTTCCAAGTCTCCACCCCATTGACGTCAATGGGAGTTTGTTTTGGCACCAAAATCAACGGGACTTTCCAAAATGTCGTAACAACTCCGCCCCATTGACGCAAATGGGCGGTAGGCGTGTACGGTGGGAGGTCTATATAAGCAGAGCTCGTTTAGTGAACCGTCAGATCGCCTGGAGACGCCATCCACGCTGTTTTGACCTCCATAGAAGACACCGGGACCGATCCAGCCTCCGCGGCCGGGAACGGTGCATTGGAAGCTTGGCATTCCGGTACTGTTGGTAAAGCCACCATGGAAGACGCCAAAAACATAAAGAAAGGCCCGGCGCCATTCTATCCGCTGGAAGATGGAACCGCTGGAGAGCAACTGCATAAGGCTATGAAGAGATACGCCCTGGTTCCTGGAACAATTGCTTTTACAGATGCACATATCGAGGTGGACATCACTTACGCTGAGTACTTCGAAATGTCCGTTCGGTTGGCAGAAGCTATGAAACGATATGGGCTGAATACAAATCACAGAATCGTCGTATGCAGTGAAAACTCTCTTCAATTCTTTATGCCGGTGTTGGGCGCGTTATTTATCGGAGTTGCAGTTGCGCCCGCGAACGACATTTATAATGAACGTGAATTGCTCAACAGTATGGGCATTTCGCAGCCTACCGTGGTGTTCGTTTCCAAAAAGGGGTTGCAAAAAATTTTGAACGTGCAAAAAAAGCTCCCAATCATCCAAAAAATTATTATCATGGATTCTAAAACGGATTACCAGGGATTTCAGTCGATGTACACGTTCGTCACATCTCATCTACCTCCCGGTTTTAATGAATACGATTTTGTGCCAGAGTCCTTCGATAGGGACAAGACAATTGCACTGATCATGAACTCCTCTGGATCTACTGGTCTGCCTAAAGGTGTCGCTCTGCCTCATAGAACTGCCTGCGTGAGATTCTCGCATGCCAGAGATCCTATTTTTGGCAATCAAATCATTCCGGATACTGCGATTTTAAGTGTTGTTCCATTCCATCACGGTTTTGGAATGTTTACTACACTCGGATATTTGATATGTGGATTTCGAGTCGTCTTAATGTATAGATTTGAAGAAGAGCTGTTTCTGAGGAGCCTTCAGGATTACAAGATTCAAAGTGCGCTGCTGGTGCCAACCCTATTCTCCTTCTTCGCCAAAAGCACTCTGATTGACAAATACGATTTATCTAATTTACACGAAATTGCTTCTGGTGGCGCTCCCCTCTCTAAGGAAGTCGGGGAAGCGGTTGCCAAGAGGTTCCATCTGCCAGGTATCAGGCAAGGATATGGGCTCACTGAGACTACATCAGCTATTCTGATTACACCCGAGGGGGATGATAAACCGGGCGCGGTCGGTAAAGTTGTTCCATTTTTTGAAGCGAAGGTTGTGGATCTGGATACCGGGAAAACGCTGGGCGTTAATCAAAGAGGCGAACTGTGTGTGAGAGGTCCTATGATTATGTCCGGTTATGTAAACAATCCGGAAGCGACCAACGCCTTGATTGACAAGGATGGATGGCTACATTCTGGAGACATAGCTTACTGGGACGAAGACGAACACTTCTTCATCGTTGACCGCCTGAAGTCTCTGATTAAGTACAAAGGCTATCAGGTGGCTCCCGCTGAATTGGAATCCATCTTGCTCCAACACCCCAACATCTTCGACGCAGGTGTCGCAGGTCTTCCCGACGATGACGCCGGTGAACTTCCCGCCGCCGTTGTTGTTTTGGAGCACGGAAAGACGATGACGGAAAAAGAGATCGTGGATTACGTCGCCAGTCAAGTAACAACCGCGAAAAAGTTGCGCGGAGGAGTTGTGTTTGTGGACGAAGTACCGAAAGGTCTTACCGGAAAACTCGACGCAAGAAAAATCAGAGAGATCCTCATAAAGGCCAAGAAGGGCGGAAAGATCGCCGTGTAATTCTAGACGAGATCCGAACTTGTTTATTGCAGCTTATAATGGTTACAAATAAAGCAATAGCATCACAAATTTCACAAATAAAGCATTTTTTTCACTGCATTCTAGTTGTGGTTTGTCCAAACTCATCAATGTATCTTATCATGTCTAGATCCAGGTAGGTTTGAGTAGTGGGCGTGGCTAAGGTGACTATAAAGGCGGGTGTCTTACGAGGGTCTTTTTGCTTTTCTGCAGACATCATGAACGGGACTGGCGGGGCCTTCGAAGGGGGGCTTTTTAGCCCTTATTTGACAACCCGCCTGCCGGGATGGGCCGGAGTTCGTCAGAATGTGATGGGATCGACGGTGGATGGGCGCCCAGTGCTTCCAGCAAATTCCTCGACCATGACCTACGCGACCGTGGGGAACTCGTCGCTCGACAGCACCGCCGCAGCCGCGGCAGCCGCAGCCGCCATGACAGCGACGAGACTGGCCTCGAGCTACATGCCCAGCAGCGGTAGTAGCCCCTCTGTGCCCAGTTCCATCATCGCCGAGGAGAAACTGCTGGCCCTGCTGGCCGAGCTGGAAGCCCTGAGCCGCCAGCTGGCCGCCCTGACCCAGCAGGTGTCCGAGCTCCGCGAACAGCAGCAGCAGCAAAATAAATGATTCAATAAACACAGATTCTGATTCAAACAGCAAAGCATCTTTATTATTTATTTTTTCGCGCGCGGTAGGCCCTGGTCCACCTCTCCCGATCATTGAGAGTGCGGTGGATTTTTTCCAGGACCCGGTAGAGGTGGGATTGGATGTTGAGGTACATGGGCATGAGCCCGTCCCGTGGGTGGAGGTAGCACCACTGCATGGCCTCGTGCTCTGGGGTCGTGTTGTAGATGATCCAGTCATAGCAGGGGCGCTGGGCGTGGTGCTGGATGATGTCCTTGAGGAGGAGACTGATGGCCACGGGGAGCCCCTTGGTGTAGGTGTTGGCAAAACGGTTGAGCTGGGAGGGATGCATGCGGGGGGAGATGATGTGCAGTTTGGCCTGGATCTTGAGGTTGGCGATGTTGCCACCCAGATCCCGCCGGGGGTTCATGTTGTGCAGGACCACCAGAACGGTGTAGCCCGTGCACTTGGGGAACTTGTCATGCAACTTGGAAGGGAATGCGTGGAAGAATTTGGAGACGCCCTTGTGCCCGCCCAGGTTTTCCATGCACTCATCCATGATGATGGCAATGGGCCCGTGGGCTGCGGCTTTGGCAAAGACGTTTCTGGGGTCAGAGACATCGTAATTATGCTCCTGGGTGAGATCATCATAAGACATTTTAATGAATTTGGGGCGGAGGGTGCCAGATTGGGGGACGATGGTTCCCTCGGGCCCCGGGGCGAAGTTCCCCTCGCAGATCTGCATCTCCCAGGCTTTCATCTCGGAGGGGGGGATCATGTCCACCTGCGGGGCGATGAAAAAAACGGTTTCCGGGGCGGGGGTGATGAGCTGCGAGGAGAGCAGGTTTCTCAACAGCTGGGACTTGCCGCACCCGGTCGGGCCGTAGATGACCCCGATGACGGGTTGCAGGTGGTAGTTCAAGGACATGCAGCTGCCGTCGTCCCGGAGGAGGGGGGCCACCTCGTTGAGCTTGTCTCTGACTTGGAGGTTTTCCCGGACGAGCTCGCCGAGGAGGCGGTCCCCGCCCAGCGAGAGAAGCTCTTGCAGGGAAGCAAAGTTTTTCAGGGGCTTGAGCCCGTCGGCCATGGGCATCTTGGCGAGGGTCTGCGAGAGGAGCTCCAGGCGGTCCCAGAGCTCGGTGACGTGCTCTACGGCATCTCGATCCAGCAGACTTCCTCGTTTCGGGGGTTGGGACGACTGCGACTGTAGGGCACGAGACGATGGGCGTCCAGCGCGGCCAGCGTCATGTCCTTCCAGGGTCTCAGGGTCCGCGTGAGGGTGGTCTCCGTCACGGTGAAGGGGTGGGCCGCGGGCTGGGCGCTTGCAAGGGTGCGCTTGAGACTCATCCTGCTGGTGCTGAAACGGGCACGGTCTTCGCCCTGCGCGTCGGCGAGATAGCAGTTGACCATGAGCTCGTAGTTGAGGGCCTCGGCGGCGTGGCCCTTGGCGCGGAGCTTGCCCTTGGAAGAGCGCCCGCAGGCGGGACAGAGGAGGGATTGCAGGGCGTAGAGCTTGGGCGCGAGAAAGACGGACTCGGGGGCGAAGGCGTCCGCTCCGCAGTGGGCGCAGACGGTCTCGCACTCGACTAGCCAGGTGAGCTCGGGCTGCTCGGGGTCAAAAACCAGTTTTCCCCCGTTCTTTTTGATGCGCTTCTTACCTCGCGTCTCCATGAGTCTGTGTCCGCGCTCGGTGACAAACAGGCTGTCTGTGTCCCCGTAGACGGACTTGATGGGCCTGTCCTGCAGGGGCGTCCCGCGGTCCTCCTCGTAGAGAAACTCAGACCACTCTGAGACGAAGGCGCGCGTCCACGCCAAGACAAAGGAGGCCACGTGCGAGGGGTAGCGGTCGTTGTCCACCAGGGGGTCCACCTTTTCCACGGTATGCAGGCACATGTCCCCCTCCTCCGCATCCAAGAAGGTGATTGGCTTGTAGGTGTAGGCCACGTGACCTGGGGTTCCCGACGGGGGGGTATAAAAGGGGGCGGGTCTGTGCTCGTCCTCACTCTCTTCCGCGTCGCTGTCCACGAGCGCCAGCTGTTGGGGTAGGTATTCCCTCTCAAGAGCGGGCATGACCTCGGCACTCAGGTTGTCAGTTTCTAGAAACGAGGAGGATTTGATGTGGGCCTGCCCTGCCGCGATGCTTTTTAGGAGACTTTCATCCATCTGGTCAGAAAAGACTATTTTTTTATTGTCAAGCTTGGTGGCGAAGGAGCCATAGAGGGCGTTTGAGAGAAGCTTGGCGATGGATCTCATGGTCTGATTTTTGTCACGGTCGGCGCGCTCCTTGGCCGCGATGTTGAGCTGGACATATTCGCGCGCGACACACTTCCATTCGGGGAAGACGGTGGTGCGCTCGTCGGGCACGATCCTGACGCGCCAGCCGCGGTTATGCAGGGTGACCAGGTCCACGCTGGTGGCCACCTCGCCGCGCAGGGGCTCGTTGGTCCAGCAGAGTCTGCCGCCCTTGCGCGAGCAGAACGGGGGCAGCACATCAAGCAGATGCTCGTCAGGGGGGTCCGCATCGATGGTGAAGATGCCCGGACAGAGTTCCTTGTCAAAATAATCGATTTTTGAGGATGCATCGTCCAAGGCCATCTGCCACTCGCGGGCGGCCAGCGCTCGCTCGTAGGGGTTGAGGGGCGGACCCCAAGGCATGGGATGCGTGAGGGCGGAGGCGTACATGCCGCAGATGTCATAGACATAGATGGGCTCCGAGAGGATGCCGATGTAGGTGGGATAGCAGCGCCCCCCGCGGATGCTTGCGCGCACGTAGTCATACAACTCGTGCGAGGGGGCCAAGAAGGCGGGGCCGAGATTGGTGCGCTGGGGCTGCTCGGCGCGGAAGACGATCTGGCGAAAGATGGCGTGCGAGTTGGAGGAGATGGTGGGCCGTTGGAAGATGTTAAAGTGGGCGTGAGGCAGGCGGACCGAGTCGCGGATGAAGTGCGCGTAGGAGTCTTGCAGCTTGGCGACGAGCTCGGCGGTGACGAGGACGTCCATGGCGCAGTAGTCCAGCGTTTCGCGGATGATGTCATAACTCGCCTCTCCTTTCTTCTCCCACAGCTCGCGGTTGAGGGCGTATTCCTCGTCATCCTTCCAGTACTCCCGGAGCGGGAATCCTCGATCGTCCGCACGGTAAGAGCCCAGCATGTAGAAATGGTTCACGGCCTTGTAGGGACAGCAGCCCTTCTCCACGGGGAGGGCGTAAGCTTGAGCGGCCTTGCGGAGCGAGGTGTGCGTCAGGGCAAAGGTGTCCCTGACCATGACTTTCAAGAACTGGTACTTGAAGTCCGAGTCGTCGCAGCCGCCGTGCTCCCAGAGCTCGAAATCGGTGCGCTTCTTCGAGAGGGGGTTAGGCAGAGCGAAAGTGACGTCATTGAAGAGAATCTTGCCTGCCCGCGGCATGAAATTGCGGGTGATGCGGAAAGGGCCCGGGACGGAGGCTCGGTTGTTGATGACCTGGGCGGCGAGGACGATCTCGTCAAAGCCGTTGATGTTGTGCCCGACGATGTAGAGTTCCATGAATCGCGGGCGGCCTTTGATGTGCGGCAGCTTTTTGAGCTCCTCGTAGGTGAGGTCCTCGGGGCATTGCAGGCCGTGCTGCTCGAGCGCCCACTCCTGGAGATGTGGGTTGGCTTGCATGAAGGAAGCCCAGAGCTCGCGGGCCATGAGGGTCTGGAGCTCGTCGCGAAAGAGGCGGAACTGCTGGCCCACGGCCATCTTTTCTGGGGTGACGCAGTAGAAGGTGAGGGGGTCCCGCTCCCAGCGATCCCAGCGTAAACGCACGGCGAGATCGCGAGCGAGGGCGACCAGCTCTGGGTCCCCGGAGAATTTCATGACCAGCATGAAGGGGACGAGCTGCTTGCCGAAGGACCCCATCCAGGTGTAGGTTTCTACATCGTAGGTGACAAAGAGCCGCTCCGTGCGAGGATGAGAGCCGATTGGGAAGAACTGGATTTCCTGCCACCAGTTGGACGAGTGGCTGTTGATGTGATGAAAGTAGAAATCCCGCCGGCGAACCGAGCACTCGTGCTGATGCTTGTAAAAGCGTCCGCAGTACTCGCAGCGCTGCACGGGCTGTACCTCATCCACGAGATACACAGCGCGTCCCTTGAGGAGGAACTTCAGGAGTGGCGGCCCTGGCTGGTGGTTTTCATGTTCGCCTGCGTGGGACTCACCCTGGGGCTCCTCGAGGACGGAGAGGCTGACGAGCCCGCGCGGGAGCCAGGTCCAGATCTCGGCGCGGCGGGGGCGGAGAGCGAAGACGAGGGCGCGCAGTTGGGAGCTGTCCATGGTGTCGCGGAGATCCAGGTCCGGGGGCAGGGTTCTGAGGTTGACCTCGTAGAGGCGGGTGAGGGCGTGCTTGAGATGCAGATGGTACTTGATTTCTACGGGTGAGTTGGTGGTCGTGTCCACGCATTGCATGAGCCCGTAGCTGCGCGGGGCCACGACCGTGCCGCGGTGCGCTTTTAGAAGCGGTGTCGCGGACGCGCTCCCGGCGGCAGCGGCGGTTCCGGCCCCGCGGGCAGGGGCGGCAGAGGCACGTCGGCGTGGCGCTCGGGCAGGTCCCGGTGCTGCGCCCTGAGAGCGCTGGCGTGCGCGACGACGCGGCGGTTGACATCCTGGATCTGCCGCCTCTGCGTGAAGACCACGGGCCCCGTGACTTTGAACCTGAAAGACAGTTCAACAGAATCAATCTCTGCGTCATTGACGGCGGCCTGACGCAGGATCTCTTGCACGTCGCCCGAGTTGTCCTGGTAGGCGATCTCGGACATGAACTGTTCGATCTCCTCCTCCTGGAGATCGCCGCGGCCCGCGCGCTCCACGGTGGCGGCGAGGTCATTGGAGATGCGACCCATGAGCTGCGAGAAGGCGCCCAGGCCGCTCTCGTTCCAGACGCGGCTGTAGACCACGTCCCCGTCGGCGTCGCGCGCGCGCATGACCACCTGCGCGAGGTTGAGCTCCACGTGCCGCGCAAAGACGGCGTAGTTGCGCAGGCGCTGGAAGAGGTAGTTGAGGGTGGTGGCGATGTGCTCGGTGACGAAGAAGTACATGATCCAGCGGCGCAGGGGCATCTCGCTGATGTCGCCGATGGCTTCCAGCCTTTCCATGGCCTCGTAGAAGTCCACGGCGAAGTTGAAAAACTGGGCGTTGCGGGCCGAGACCGTGAGCTCGTCTTCCAGGAGCCGGATGAGTTCGGCGATGGTGGCGCGCACCTCGCGCTCGAAATCCCCGGGGGCCTCCTCCTCTTCCTCTTCTTCCATGACGACCTCTTCTTCTATTTCTTCCTCTGGGGGCGGTGGTGGTGGCGGGGGCCGACGACGACGGCGACGCACCGGGAGACGGTCGACGAAGCGCTCGATCATCTCCCCGCGGCGGCGACGCATGGTTTCGGTGACGGCGCGACCCCGTTCGCGAGGACGCAGCGTGAAGACGCCGCCGGTCATCTCCCGGTAATGGGGCGGGTCCCCATTGGGCAGCGATAGGGCGCTGACGATGCATCTTATCAATTGCGGTGTAGGGGACGTGAGCGCGTCGAGATCGACCGGATCGGAGAATCTTTCGAGGAAAGCGTCTAGCCAATCGCAGTCGCAAGGTAAGCTCAAACACGTAGCAGCCCTGCGGACGCTGTTAGAATTGCGGTTGCTGATGATGTAATTGAAGTAGGCGTTTTTGAGGCGGCGGATGGTGGCGAGGAGGACCAGGTCCTTGGGTCCAGCTTGCTGGATGCGGAGCCGCTCGGCCATGCCCCAGGCCTGGCCCTGACACCGGCTCAGGTTCTTGTAGTAGTCATGCATGAGCCTCTCAATGTCATCACTGGCTGAGGCGGAGTCTTCCATGCGGGTGACCCCGACGCCCCTGAGCGGCTGCACGAGCGCCAGGTCGGCGACGACGCGCTCGGCGAGGATGGCCTGTTGCACGCGGGTGAGGGTGTCCTGGAAGTCGTCCATGTCGACGAAGCGGTGATAGGCCCCGGTGTTGATGGTGTAGGTGCAGTTGGCCATGAGCGACCAGTTGACGGTCTGCAGGCCTGGCTGCACGACCTCGGAGTACCTGAGCCGCGAGAAGGCGCGCGAGTCGAAGACGTAGTCGTTGCAGGTGCGCACGAGGTACTGGTATCCGACTAGGAAGTGCGGCGGCGGCTGGCGGTAGAGCGGCCAGCGCTGGGTGGCCGGCGCGCCCGGGGCCAGGTCCTCGAGCATGAGGCGGTGGTAGCCGTAGAGGTAGCGGGACATCCAGGTGATGCCGGCGGCGGTGGTGGAGGCGCGCGGGAACTCGCGGACGCGGTTCCAGATGTTGCGCAGCGGCAGGAAATAGTCCATGGTCGGCACGGTCTGGCCGGTGAGACGCGCGCAGTCATTGACGCTCTAGAGGCAAAAACGAAAGCGGTTGAGCGGGCTCTTCCTCCGTAGCCTGGCGGAACGCAAACGGGTTAGGCCGCGTGTGTACCCCGGTTCGAGTCCCCTCGAATCAGGCTGGAGCCGCGACTAACGTGGTATTGGCACTCCCGTCTCGACCCGAGCCCGATAGCCGCCAGGATACGGCGGAGAGCCCTTTTTGCCGGCCGAGTGGGGTCGCTAGACTTGAAAGCGACCGAAAACCCTGCCGGGTAGTGGCTCGCGCCCGTAGTCTGGAGAAGCATCGCCAGGGTTGAGTCGCGGCAGAACCCGGTTCGAGGACGGCCGCGGCGAGCGGGACTTGGTCACCCCGCCGATATAAAGACCCACAGCCAGCCGACTTCTCCAGTTACGGGAGCGAGCCCCCTTTTTTCTTTTTGCCAGATGCATCCCGTCCTGCGCCAAATGCGTCCCACCCCCCCGGCGACCACCGCGACCGCGGCCGTAGCAGGCGCCGGCGCTAGCCAGCCACCACAGACAGAGATGGACTTGGAAGAGGGCGAAGGGCTGGCAAGACTGGGGGCGCCGTCCCCGGAGCGACATCCCCGCGTGCAGCTGCAGAAGGACGTGCGCCCGGCGTACGTGCCTACGCAGAACCTGTTCAGGGACCGCAGCGGGGAGGAGCCCGAGGAGATGCGCGACTGCCGGTTTCGGGCGGGCAGGGAGCTGCGCGAGGGCCTGGACCGCCAGCGCGTGCTGCGCGACGAGGATTTCGAGCCGAACGAGCAGACGGGGATCAGCCCCGCACGCGCGCACGTGGCGGCAGCCAACCTGGTGACGGCCTACGAGCAGACGGTGAAGCAGGAGCGCAACTTCCAAAAGAGTTTCAACAACCACGTGCGCACCCTGATCGCGCGCGAGGAGGTGGCCCTGGGCCTGATGCACCTGTGGGACCTGGCGGAGGCCATCGTGCAGAACCCGGACAGCAAGCCTCTGACGGCGCAGCTGTTCCTGGTGGTGCAGCACAGCAGGGACAACGAGGCGTTCAGGGAGGCGCTGCTGAACATCGCCGAGCCCGAGGGTCGCTGGCTGCTGGAGCTGATTAACATCTTGCAGAGCATCGTAGTGCAGGAGCGCAGCCTGAGCCTGGCCGAGAAGGTGGCGGCGATCAACTACTCGGTGCTGAGCCTGGGCAAGTTTTACGCGCGCAAGATTTACAAGACGCCGTACGTGCCCATAGACAAGGAGGTGAAGATAGACAGCTTTTACATGCGCATGGCGCTCAAGGTGCTGACGCTGAGCGACGACCTGGGCGTGTACCGCAACGACCGCATCCACAAGGCCGTGAGCACGAGCCGGCGGCGCGAGCTGAGCGACCGCGAGCTGATGCTGAGTCTGCGCCGGGCGCTGGTAGGGGGCGCCGCCGGCGGCGAGGAGTCCTACTTCGACATGGGTGCGGACCTGCATTGGCAGCCGAGCCGGCGCGCCTTGGAGGCCGCCTACGGTTCAGAGGACTTGGATGAGGAAGAGGAAGAGGAGGAGGATGCACCCGCTGCGGGGTACTGACGCCTCCGTGATGTGTTTTTAGATGTCCCAGCAAGCCCCGGACCCCGCCATAAGGGCGGCGCTGCAAAGCCAGCCGTCCGGTCTAGCATCGGACGACTGGGAGGCCGCGATGCAACGCATCATGGCCCTGACGACCCGCAACCCCGAGTCCTTTAGACAACAGCCGCAGGCCAACAGACTCTCGGCCATTCTGGAGGCGGTGGTCCCCTCTCGGACCAACCCCACGCACGAGAAGGTGCTGGCGATCGTGAACGCGCTGGCGGAGAACAAGGCCATCCGTCCCGACGAGGCCGGGCTGGTGTACAACGCCCTGCTGGAGCGCGTGGGCCGCTACAACAGCACGAACGTGCAGTCCAACCTGGATCGGCTGGTGACGGACGTGCGCGAGGCCGTGGCGCAGCGCGAGCGGTTCAAGAACGAGGGCCTGGGCTCGCTGGTGGCGCTGAACGCCTTCCTGGCGACGCAGCCGGCGAACGTGCCGCGCGGGCAGGACGATTACACCAACTTTATCAGCGCGCTGCGGCTGATGGTGACCGAGGTGCCCCAGAGCGAGGTGTACCAGTCTGGCCCGGACTACTTTTTCCAGACGAGCCGGCAGGGCTTGCAGACGGTGAACCTGAGCCAGGCTTTCAAGAATCTGCGCGGGCTGTGGGGCGTGCAGGCGCCCGTGGGCGACCGGTCAACGGTGAGCAGCTTGCTGACGCCCAACTCGCGGCTGCTGCTGCTGCTGATCGCGCCCTTCACCGACAGCGGCAGCGTGAACCGCAACTCGTACCTGGGCCATCTGCTGACGCTGTACCGCGAGGCCATAGGCCAGGCGCAGGTGGACGAGCAGACCTTCCAGGAGATCACTAGCGTGAGCCGCGCGCTGGGGCAGAACGACACCGACAGTCTGAGGGCCACCCTGAACTTTTTGCTGACCAATAGACAGCAGAAGATCCCGGCGCAGTACGCACTGTCGGCCGAGGAGGAAAGGATTCTGAGATATGTGCAGCAGAGCGTAGGGCTGTTCCTGATGCAGGAGGGTGCCACCCCCAGCGCCGCGCTGGACATGACCGCGCGCAACATGGAACCTAGCATGTACGCCGCCAACCGGCCGTTCATCAATAAGCTGATGGACTACTTGCACCGCGCGGCGGCCATGAACACGGACTACTTTACCAACGCCATCCTGAACCCGCACTGGCTCCCGCCGCCGGGGTTCTACACGGGCGAGTACGACATGCCCGACCCCAACGACGGGTTCCTGTGGGACGACGTGGACAGCGCGGTGTTCTCGCCGACCTTTCAAAAGCGCCAGGAGGCGCCGCCGAGCGAGGGCGCGGTGGGGAGGAGCCCCTTTCCTAGCTTAGGGAGTTTGCATAGCTTGCCGGGCTCGGTGAACAGCGGCAGGGTGAGCCGGCCGCGCTTGCTGGGCGAGGACGAGTACCTGAACGACTCGCTGCTGCAGCCGCCGCGGGCCAAGAACGCCATGGCCAATAACGGGATAGAGAGTCTGGTGGACAAACTGAACCGCTGGAAGACCTACGCTCAGGACCATAGGGACGCGCCCGCGCCGCGGCGACAGCGCCACGACCGGCAGCGGGGCCTGGTGTGGGACGACGAGGACTCGGCCGACGATAGCAGCGTGTTGGACTTGGGCGGGAGCGGTGGGGTCAACCCGTTCGCGCATCTGCAGCCCAAACTGGGGCGACGGATGTTTTGAATGAAATAAAACTCACCAAGGCCATAGCGTGCGTTCTCTTCCTTGTTAGAGATGAGGCGCGCGGTGGTGTCTTCCTCTCCTCCTCCCTCGTACGAGAGCGTGATGGCGCAGGCGACCCTGGAGGTTCCGTTTGTGCCTCCGCGGTATATGGCTCCTACGGAGGGCAGAAACAGCATTCGTTACTCGGAGCTGGCTCCGCAGTACGACACCACTCGCGTGTACTTGGTGGACAACAAGTCGGCGGACATCGCTTCCCTGAACTACCAAAACGACCACAGCAACTTCCTGACCACGGTGGTGCAGAACAACGATTTCACCCCCGCCGAGGCCAGCACGCAGACGATAAATTTTGACGAGCGGTCGCGGTGGGGCGGTGATCTGAAGACCATTCTGCACACTAACATGCCCAATGTGAACGAGTACATGTTCACCAGCAAGTTTAAGGCGCGGGTGATGGTGTCTAGGAAGCATCCAGAGGGGGTAGTTGAAACAGATTTGAGTCAGGATAAGCTTGAATATGAGTGGTTTGAGTTTACCCTGCCCGAGGGAAACTTTTCCGAGACCATGACCATAGACCTGATGAACAACGCCATCTTGGAAAACTACTTGCAAGTGGGGCGGCAGAATGGCGTGCTGGAGAGCGATATCGGAGTCAAGTTTGACAGCAGAAATTTCAAGCTGGGCTGGGACCCGGTGACCAAGCTGGTGATGCCAGGGGTCTACACCTACGAGGCCTTCCACCCGGACGTGGTGCTGCTGCCGGGCTGCGGGGTGGACTTCACCGAGAGCCGCCTGAGCAACCTCCTGGGCATTCGCAAGAAGCAACCTTTCCAAGAGGGCTTCAGAATCATGTATGAGGATCTAGAAGGTGGCAACATCCCCGCCCTCCTTGATGTGCCCAAGTACTTGGAAAGCAAGAAGAAAGTTGAAGACGAAACTAAAAATGCAGCTGCGGCCACAGCCGATACAACCACTAGGGGTGATACATTTGCAACTCCAGCGCAAGAGACAGCAGCTGATAAGAAGGTAGAAGTCTTGCCCATTGAAAAGGATGAGAGTGGTAGAAGTTACAACCTGATCCAGGGGACCCACGACACGCTGTACCGCAGTTGGTACCTGTCCTATACCTACGGGGACCCCGAGAAGGGGGTGCAGTCGTGGACGCTGCTCACCACCCCGGACGTTACCTGCGGCGCGGAGCAAGTCTACTGGTCACTGCCGGACCTCATGCAAGACCCCGTCACCTTCCGCTCCACCCAGCAAGTCAGCAACTACCCCGTGGTCGGCGCCGAGCTCATGCCCTTCCGCGCCAAGAGCTTTTACAACGACCTCGCCGTCTACTCCCAGCTCATCCGCAGCTACACCTCCCTCACCCACGTCTTCAACCGCTTCCCCGACAACCAGATCCTCTGCCGCCCGCCCGCGCCCACCATCACCACCGTCAGTGAAAACGTGCCTGCTCTCACAGATCACGGGACGCTACCGCTGCGCAGCAGTATCCGCGGAGTCCAGCGAGTGACCGTCACTGACGCCCGTCGCCGCACCTGTCCCTACGTCTACAAGGCCCTGGGCATAGTCGCGCCGCGCGTGCTTTCCAGTCGCACCTTCTAAAAAAATGTCTATTCTCATCTCGCCCAGCAATAACACCGGCTGGGGTCTTACTAGACCCAGCACCATGTACGGAGGAGCCAAGAAGCGCTCCCAGCAGCACCCCGTCCGCGTCCGCGGCCACTTCCGCGCTCCCTGGGGCGCATACAAGCGCGGGCGGACTTCCACCGCCGCCGTGCGCACCACCGTCGACGACGTCATCGACTCGGTGGTCGCCGACGCGCGCAACTATACCCCCGCCCCCTCCACCGTGGACGCGGTCATCGACAGCGTGGTGGCCGACGCGCGCGACTATGCCAGACGCAAGAGCCGGCGGCGACGGATCGCCAGGCGCCACCGGAGCACGCCCGCCATGCGCGCCGCCCGGGCTCTGCTGCGCCGCGCCAGACGCACGGGCCGCCGGGCCATGATGCGAGCCGCGCGCCGCGCTGCCACTGCACCCACCCCCGCAGGCAGGACTCGCAGACGAGCGGCCGCCGCCGCCGCTGCGGCCATCTCTAGCATGACCAGACCCAGGCGCGGAAACGTGTACTGGGTGCGCGACTCCGTCACGGGCGTGCGCGTGCCCGTGCGCACCCGTCCTCCTCGTCCCTGATCTAATGCTTGTGTCCTCCCCCGCAAGCGACGATGTCAAAGCGCAAAATCAAGGAGGAGATGCTCCAGGTCGTCGCCCCGGAGATTTACGGACCACCCCAGGCGGACCAGAAACCCCGCAAAATCAAGCGGGTTAAAAAAAAGGATGAGGTGGACGAGGGGGCAGTAGAGTTTGTGCGCGAGTTCGCTCCGCGGCGGCGCGTAAATTGGAAGGGGCGCAGGGTGCAGCGCGTGTTGCGGCCCGGCACGGCGGTGGTGTTCACGCCCGGCGAGCGGTCCTCGGTCAGGAGCAAGCGTAGCTATGACGAGGTGTACGGCGACGACGACATCCTGGACCAGGCGGCGGAGCGGGCGGGCGAGTTCGCCTACGGGAAGCGGTCGCGCGAAGAGGAGCTGATCTCGCTGCCGCTGGACGAAAGCAACCCCACGCCGAGCCTGAAGCCCGTGACCCTGCAGCAGGTGCTGCCCCAGGCGGTGCTGCTGCCGAGCCGCGGGGTCAAGCGCGAGGGCGAGAGCATGTACCCGACCATGCAGATCATGGTGCCCAAGCGCCGGCGCGTGGAGGACGTGCTGGACACCGTGAAAATGGATGTGGAGCCCGAGGTCAAGGTGCGCCCCATCAAGCAGGTGGCGCCGGGCCTGGGCGTGCAAACCGTGGACATTCAGATCCCCACCGACATGGATGTCGACAAAAAACCCTCGACCAGCATCGAGGTGCAAACCGACCCCTGGCTCCCAGCCTCCACCGCTACCGTCTCCACTTCTACCGCCGCCACGGCTACCGAGCCTCCCAGGAGGCGAAGATGGGGCGCCGCCAGCCGGCTGATGCCCAACTACGTGTTGCATCCTTCCATCATCCCGACGCCGGGCTACCGCGGCACCCGGTACTACGCCAGCCGCCGGCGCCCAGCCAGCAAACGCCGCCGCCGCACCGCCACCCGCCGCCGTCTGGCCCCCGCCCGCGTGCGCCGCGTGACCACGCGCCGGGGCCGCTCGCTCGTTCTGCCCACCGTGCGCTACCACCCCAGCATCCTTTAATCCGTGTGCTGTGATACTGTTGCAGAGAGATGGCTCTCACTTGCCGCCTGCGCATCCCCGTCCCGAATTACCGAGGAAGATCCCGCCGCAGGAGAGGCATGGCAGGCAGCGGCCTGAACCGCCGCCGGCGGCGGGCCATGCGCAGGCGCCTGAGTGGCGGCTTTCTGCCCGCGCTCATCCCCATAATCGCCGCGGCCATTGGCACGATCCCGGGCATAGCTTCCGTTGCGCTGCAGGCGTCGCAGCGCCGTTGATGTGCGAATAAAGCCTCTTTAGACTCTGACACACCTGGTCCTGTATATTTTTAGAATGGAAGACATCAATTTTGCGTCCCTGGCTCCGCGGCACGGCACGCGGCCGTTCATGGGCACCTGGAACGAGATCGGCACCAGCCAGCTGAACGGGGGCGCCTTCAATTGGAGCAGTGTCTGGAGCGGGCTTAAAAATTTCGGCTCGACGCTCCGGACCTATGGGAACAAGGCCTGGAATAGTAGCACGGGGCAGTTGTTGAGGGAAAAGCTCAAAGACCAGAACTTCCAGCAGAAGGTGGTGGACGGGCTGGCCTCGGGCATTAACGGGGTGGTGGACATCGCGAACCAGGCCGTGCAGCGCGAGATAAACAGCCGCCTGGACCCGCGACCGCCCACGGTGGTGGAGATGGAAGATGCAACTCTTCCGCCGCCCAAGGGCGAGAAGCGGCCGCGGCCCGACGCGGAGGAGACGATCCTGCAGGTGGACGAGCCGCCCTCGTACGAGGAGGCCGTCAAGGCCGGCATGCCCACCACGCGCATCATCGCGCCGCTGGCCACGGGTGTAATGAAACCCGCCACCCTTGACCTGCCTCCACCACCCGCGCCCGCTCCACCGAAGGCAACTCCGGTTGTGCAGGCCCCCCCGGTGGCGACCGCCGTGCGCCGCGTCCCCGCCCGCCGCCAGGCCCAGAACTGGCAGAGCACGCTGCACAGTATCGTGGGCCTGGGAGTGAAAAGTCTGAAGCGCCGCCGATGCTATTGAGAGAGAGGAAAGAGGACACTAAAGGGAGAGCTTAACTTGTATGTGCCTTACCGCCAGAGAACGCGCGAAGATGGCCACCCCCTCGATGATGCCGCAGTGGGCGTACATGCACATCGCCGGGCAGGACGCCTCGGAGTACCTGAGCCCGGGTCTGGTGCAGTTTGCCCGCGCCACCGACACGTACTTCAGCCTGGGCAACAAGTTTAGGAACCCCACGGTGGCCCCGACCCACGATGTGACCACGGACCGGTCCCAGCGTCTGACGCTGCGCTTCGTGCCCGTGGATCGCGAGGACACCACGTACTCGTACAAGGCGCGCTTCACTCTGGCCGTGGGCGACAACCGGGTGCTAGACATGGCCAGCACTTACTTTGACATCCGCGGCGTCCTGGACCGCGGTCCCAGCTTCAAACCCTACTCGGGCACGGCCTACAACAGCCTGGCTCCCAAGGGTGCCCCCAATCCCAGCCAGTGGGAGCAAAATGAAACCAATGTTAATAAAACACACACCTTTGGGATGGCAGCCATGAAAGGAGAAGCTATTGACAAAAATGGTCTGCAAATTGGAACTGACGCGGCGGATCAGGATAAACCAATTTATGCAGATAAAACTTTCCAGCCAGAACCTCAAGTAGGAGAGGAAGACTGGATTGATAAAGCAGATTTCTATGGCGGAAGAGCTCTTAAAAAAGACACTAAAATGAAACCATGCTATGGATCTTTTGCTAGACCTACTAATGAGAAAGGAGGTCAGGCAAAGTTCAAACCAGTTAATGAAGGAGAACAACCTAAAGATCTGGATATAGATATGAACTTCTTTGACCCAACCACTATTAACACACCAGATGTAGTGCTGTACACTGAAAATGTTAATCTTGAAACACCAGACACTCATGTGGTTTACAAGGCAGGAACTTCAGATGACAGTTCTGAGGTCAATTTGGCTCAGCAGTCCATGCCAAACAGACCCAACTACATTGGCTTTAGGGACAACTTTGTAGGTCTCATGTATTACAACAGCACCGGAAATATGGGTGTGCTGGCTGGTCAGGCTTCTCAGTTGAACGCTGTGGTCGACTTGCAAGACAGAAACACCGAGTTATCTTACCAGCTATTGCTAGATTCTCTGGGTGACAGAACCAGATACTTTAGCATGTGGAACTCTGCGGTGGACAGTTACGATCCAGATGTCAGGATCATTGAAAATCACGGTGTGGAAGATGAACTTCCAAACTATTGCTTCCCATTGGATGGTGTGGGCACTAATACTGCATACCAAGGCGTTAAAGTTAAGACAACTAATGGAAACGACACGTGGGAAAAAGATGAAACTGTTTATGAGTTTAATCAAATTGGCAAGGGGGATATCTATGCCATGGAGATCAACCTGCAGGCCAACCTGTGGAAGAGTTTTCTGTACTCGAACGTGGCCCTGTACCTGCCCGACTCCTACAAGTACACGCCGGCCAACGTCAAGCTGCCCGCCAACACCAACACCTACGAGTACATGAACGGCCGCGTGGTAGCCCCCTCGCTGGTGGACGCCTACATCAACATCGGCGCCCGCTGGTCGTTGGATCCCATGGACAACGTCAACCCCTTCAACCACCACCGCAATGCGGGCCTGCGCTACCGCTCCATGCTGCTGGGCAACGGCCGCTACGTGCCCTTCCACATCCAAGTGCCCCAAAAGTTCTTTGCCATCAAGAACCTGCTCCTGCTCCCGGGCTCCTACACCTACGAGTGGAACTTCCGCAAGGACGTCAACATGATCCTGCAGAGTTCCCTCGGCAACGACCTGCGCGTCGACGGCGCCTCCGTCCGCTTCGACAGCGTCAACCTATACGCCACTTTCTTCCCCATGGCGCACAACACCGCTTCAACCTTGGAAGCCATGCTGCGCAACGACACCAACGACCAGTCCTTCAACGACTACCTCTCGGCCGCCAACATGCTCTACCCCATCCCGGCCAAGGCCACCAACGTGCCCATCTCCATCCCATCGCGCAACTGGGCCGCCTTCCGCGGCTGGAGTTTCACCCGGCTCAAGACCAAGGAAACTCCTTCCCTCGGCTCGGGTTTCGACCCCTACTTTGTCTACTCGGGCTCCATCCCCTACCTCGACGGGACCTTCTACCTCAACCACACCTTCAAGAAGGTCTCCATCATGTTCGACTCCTCGGTCAGCTGGCCCGGCAACGACCGGCTGCTCACGCCGAACGAGTTCGAGATCAAGCGCAGCGTCGACGGGGAGGGCTACAACGTGGCCCAATGCAACATGACCAAGGACTGGTTCCTCGTCCAGATGCTCTCCCACTACAACATCGGCTACCAGGGCTTCCACGTGCCCGAGGGCTACAAGGACCGCATGTACTCCTTCTTCCGCAACTTCCAGCCCATGAGCAGGCAGGTGGTCGATGAGATCAACTACAAGGACTACAAGGCCGTCACCCTGCCCTTCCAGCACAATAACTCGGGCTTCACCGGCTACCTCGCACCCACCATGCGCCAGGGGCAGCCCTACCCCGCCAACTTCCCCTACCCGCTCATCGGTCAGACAGCCGTGCCCTCCGTCACCCAGAAAAAGTTCCTCTGCGACAGGGTCATGTGGCGCATCCCCTTCTCCAGCAACTTCATGTCCATGGGCGCCCTCACCGACCTGGGTCAGAACATGCTCTACGCCAACTCGGCCCACGCGCTCGACATGACCTTCGAGGTGGACCCCATGGATGAGCCCACCCTCCTCTATCTTCTCTTCGAAGTTTTCGACGTGGTCAGAGTACACCAGCCGCACCGCGGCGTCATCGAGGCCGTCTACCTGCGCACGCCCTTCTCCGCCGGCAACGCCACCACCTAAGCATGAGCGGCTCCAGCGAACGAGAGCTCGCGGCCATCGTGCGCGACCTGGGCTGCGGGCCCTACTTTTTGGGCACCCACGACAAGCGCTTCCCGGGCTTTCTCGCCGGCGACAAGCTGGCCTGCGCCATCGTCAACACGGCCGGCCGCGAGACCGGAGGCGTGCACTGGCTCGCCTTCGGCTGGAACCCGCGCTCGCGCACCTGCTACATGTTCGACCCCTTTGGGTTCTCGGACCGCCGGCTCAAGCAGATTTACAGCTTCGAGTACGAGGCCATGCTGCGCCGCAGCGCCCTGGCCTCCTCGCCCGACCGCTGTCTCAGCCTCGAGCAGTCCACTCAGACCGTGCAGGGGCCCGACTCCGCCGCCTGCGGACTCTTCTGTTGCATGTTCTTGCATGCCTTCGTGCACTGGCCCGACCGACCCATGGACGGAAACCCCACCATGAACTTGCTGACGGGGGTGCCCAACGGCATGCTACAATCGCCACAGGTGCTGCCCACCCTCAGGCGCAACCAGGAGGAACTCTACCGCTTCCTCGCGCGCCACTCCCCTTACTTTCGCTCCCACCGCGCCGCCATCGAACACGCCACCGCTTTTGACAAAATGAAACAACTGCGTGTATCTCAATAAACAGCACTTTTATTTTACATGCACTGGAGTATATGCAAGTTATTTAAAAGTCGAAGGGGTTCTCGCGCTCGTCGTTGTGCGCCGCGCTGGGGAGGGCCACGTTGCGGTACTGGTACTTGGGCTGCCACTTGAACTCGGGGATCACCAGTTTGGGCACTGGGGTCTCGGGGAAGGTCTCGCTCCACATGCGCCGGCTCATCTGCAGGGCGCCCAGCATGTCCGGGGCGGAGATCTTGAAATCGCAGTTGGGGCCGGTGCTCTGCGCGCGCGAGTTGCGGTACACGGGGTTGCAGCACTGGAACACCATCAGACTGGGGTACTTCACACTAGCCAGCACGCTCTTGTCGCTGATCTGATCCTTGTCCAGATCCTCGGCGTTGCTCAGGCCGAACGGGGTCATCTTGCACAGCTGGCGTCCCAGGAAGGGCACGCTCTGAGGCTTGTGGTTACACTCGCAGTGCACGGGCATCAGCATCATCCCCGCGCCGCGCTGCATATTCGGGTAGAGGGCCTTGACAAAGGCCGCGATCTGCTTGAAAGCTTGCTGGGCCTTGGCCCCCTCGCTGAAAAACAGGCCGCAGCTCTTCCCGCTGAACTGGTTATTCCCACACCCGGCATCCTGCACGCAGCAGCGCGCGTCATGGCTGGTCAGTTGCACCACGCTCCGTCCCCAGCGGTTCTGGGTCACCTTAGCCTTGCTGGGCTGCTCCTTCAACGCGCGCTGCCCGTTCTCGCTGGTCACATCCATCTCCACCACGTGGTCCTTGTGGATCATCATCGTCCCGTGCAGACACTTGAGCTGGCCTTCCACCTCGGTGCAGCCGTGATCCCACAGGGCGCAACCGGTGCACTCCCAGTTCTTGTGCGCAATCCCGCTGTGGCTGAAGATGTAACCTTGCAACATGCGGCCCATGATGGTGCTAAATGCTTTCTGGGTGGTGAAGGTCAGTTGCATCCCGCGGGCCTCCTCGTTCATCCAGGTCTGGCACATCTTCTGGAAGATCTCGGTCTGCTCGGGCATGAGCTTGTAAGCATCGCGCAGGCCGCTGTCGACGCGGTAGCGTTCCATCAGCACGTTCATGGTATCCATGCCCTTCTCCCAGGACGAGACCAGAGGCAGACTCAGAGGGTTGCGTACGTTCAGGACACCGGGGGTCGCGGGCTCGACGATGCGTTTTCCGTCCTTGCCTTCCTTCAATAGAACCGGCGGCTGGCTGAATCCCACTCCCACGATCACGGCATCTTCCTGGGGCATCTCTTCGTCGGGGTCTACCTTGGTCACATGCTTGGTCTTTCTGGCTTGCTTCTTTTTTGGAGGGCTGTCCACGGGGAGCACGTCCTCCTCGGAAGACCCGGAGCCCACCCGCTGATACTTTCGGCGCTTGGTGGGCAGAGGAGGTGGCGGCGAGGGGCTCCTCTCCTGCTCCGGCGGATAGCGCGCCGACCCGTGGCCCCGGGGCGGAGTGGCCTCTCGGCCCATGAACCGGCGCACGTCCTGACTGCCGCCGGCCATTGTTTCCTAGGGGAAGATGGAGGAGCAGCCGCGTAAGCAGGAGCAGGAGGAGGACTTAACCACCCACGAGCAACCCAAAATCGAGCAGGACCTGGGCTTCGAAGAGCCGGCTCGTCTAGAACCCCCACAGGATGAACAGGAGCACGAGCAAGACGCAGGCCAGGAGGAGACCGACGCTGGGCTCGAGCATGGCTACCTGGGAGGAGAGGAGGATGTGCTGCTGAAACACCTGCAGCGCCAGTCCCTCATCCTCCGGGACGCCCTGGCCGACCGGAGCGAAACCCCCCTCAGCGTCGAGGAGCTGTGTCGGGCCTACGAGCTCAACCTCTTCTCGCCGCGCGTACCCCCCAAACGCCAGCCCAACGGCACCTGCGAGCCCAACCCGCGTCTCAACTTCTATCCCGTCTTTGCGGTCCCCGAAGCCCTCGCCACCTATCACATCTTTTTCAAGAACCAAAAGATCCCCGTCTCCTGCCGCGCCAACCGCACCAGCGCCGACGCGCTCCTCGCTTTGGGGCCCGGCGCGCGCATACCTGATATCGCTTCCCTGGAAGAGGTGCCCAAGATCTTCGAAGGGCTCGGTCGGGACGAGACGCGCGCGGCGAACGCTCTGAAAGAAACAGCAGAGGAAGAGGGTCACACTAGCGCCCTGGTAGAGTTGGAAGGCGACAACGCCAGGCTGGCCGTGCTCAAGCGCAGCGTCGAGCTTACCCACTTCGCCTACCCCGCCGTCAACCTCCCGCCCAAGGTCATGCGTCGCATCATGGATCAGCTCATCATGCCCCACATCGAGGCCCTCGATGAAAGTCAGGAGCAGCGCCCCGAGGACGCCCGGCCCGTGGTCAGCGACGAGATGCTCGCGCGCTGGCTCGGGACCCGCGACCCCCAGGCTTTGGAACAGCGGCGCAAACTCATGCTGGCCGTGGTCCTGGTCACCCTTGAGCTCGAATGCATGCGCCGCTTTTTCAGCGACCCCGAGACCCTGCGCAAGGTCGAGGAGACCCTGCACTACACTTTCAGGCACGGTTTCGTCAGGCAGGCCTGCAAGATCTCCAACGTGGAGCTGACCAACCTGGTCTCCTGCCTGGGGATCCTGCACGAGAACCGCCTGGGCCAGACCGTGCTCCACTCTACCCTGAAGGGCGAGGCGCGGCGGGACTATGTCCGCGACTGCGTCTTTCTCTTTCTCTGCCACACATGGCAAGCGGCCATGGGCGTGTGGCAGCAGTGTCTCGAGGACGAGAACCTAAAGGAGCTGGACAAGCTTCTTGCTAGAAACCTTAAAAAGCTGTGGACGGGCTTCGACGAGCGCACCGTCGCCTCGGACCTGGCCGAGATCGTCTTCCCCGAGCGCCTGAGACAGACGCTGAAAGGCGGGCTGCCCGACTTCATGAGCCAGAGCATGTTGCAAAACTACCGCACTTTCATTCTTGAGCGATCAGGCATCCTGCCCGCCACCTGCAACGCCTTCCCCTCCGACTTTGTACCGCTGAGCTACCGCGAGTGTCCCCCGCCGCTGTGGAGCCACTGCTACCTCTTGCAGCTGGCCAACTACATCGCCTACCACTCGGACGTGATCGAGGACGTGAGCGGCGAGGGGCTGCTCGAGTGCCACTGTCGCTGCAACCTGTGCTCCCCGCATCGCTCCCTGGTCTGCAACCCCCAGCTCCTGAGCGAGACCCAGGTCATCGGTACCTTCGAGCTGCAAGGTCCGCAGGAGTCCACCGCTCCGCTGAAACTCACGCCGGGGTTGTGGACTTCCGCGTACCTGCGCAAATTTGTACCCGAAGACTACCACGCCCATGAGATAAAGTTCTTTGAGGACCAATCGCGTCCGCAGCACGCGGATCTCACGGCCTGCGTCATCACCCAGGGCGCGATCCTCGCCCAATTGCACGCCATCCAAAAATCCCGCCAAGAGTTTCTTCTGAAAAAGGGTAGAGGGGTCTACCTGGACCCCCAGACGGGCGAGGTGCTCAACCCGGGTCTCCCCCAGCATGCCGAGGAAGAAGCAGGAGCCGCTAGTGGAGGAGATGGAAGAAGAATGGGACAGCCAGGCAGAGGAGGACGAATGGGAGGAGGAGACAGAGGAGGAAGAATTGGAAGAGGTGGAAGAGGAGCAGGCAACAGAGCAGCCCGTCGCCGCACCATCCGCGCCGGCAGCCCCGCCGGTCACGGATACAACCTCCGCTCCGGTCAAGCCTCCTCGTAGATGGGATCAAGTGAAGGGTGACGGTAAGCACGAGCGGCAGGGCTACCGATCATGGAGGGCCCACAAAGCCGCGATCATCGCCTGCTTGCAAGACTGCGGGGGGAACATCGCTTTCGCCCGCCGCTACCTGCTCTTCCACCGCGGGGTGAACATCCCCCGCAACGTGTTGCATTACTACCGTCACCTTCACAGCTAAGAAAAAGCAAGTCAAAGGAGTCGCCGGAGGAGGAGGAGGAGGCCTGAGGATCGCGGCGAACGAGCCCTTGACCACCAGGGAGCTGAGGAACCGGATCTTCCCCACTCTTTATGCCATTTTTCAGCAGAGTCGAGGTCAGCAGCAAGAGCTCAAAGTAAAAAACCGGTCTCTGCGCTCGCTCACCCGCAGTTGCTTGTACCACAAAAACGAAGATCAGCTGCAGCGCACTCTCGAAGACGCCGAGGCTCTGTTCCACAAGTACTGCGCGCTCACTCTTAAAGACTAAGGCGCGCCCACCCGGAAAAAAGGCGGGAATTACCTCATCGCCACCATGAGCAAGGAGATTCCCACCCCTTACATGTGGAGCTATCAGCCCCAAATGGGCCTGGCCGCGGGCGCCTCCCAGGACTACTCCACCCGCATGAACTGGCTCAGTGCCGGCCCCTCGATGATCTCACGGGTCAACGGGGTCCGCAGTCATCGAAACCAGATATTGTTGGAGCAGGCGGCGGTCACCTCCACGCCCAGGGCAAAGCTCAACCCGCGTAATTGGCCCTCCACCCTGGTGTATCAGGAAATCCCCGGGCCGACTACCGTACTACTTCCGCGTGACGCACTGGCCGAAGTCCGCATGACTAACTCAGGTGTCCAGCTGGCCGGCGGCGCTTCCCGGTGCCCGCTCCGCCCACAATCGGGTATAAAAACCCTGGTGATCCGAGGCAGAGGCACACAGCTCAACGACGAGTTGGTGAGCTCTTCGATCGGTCTGCGACCGGACGGAGTGTTCCAACTAGCCGGAGCCGGGAGATCCTCCTTCACTCCCAACCAGGCCTACCTGACCTTGCAGAGCAGCTCTTCGGAGCCTCGCTCCGGAGGCATCGGAACCCTCCAGTTTGTGGAGGAGTTTGTGCCCTCGGTCTACTTCAACCCCTTCTCGGGATCGCCAGGCCTCTACCCGGACGAGTTCATACCGAACTTCGACGCAGTGAGAGAAGCGGTGGACGGCTACGACTGAATGTCCCATGGTGACTCGGCTGAGCTCGCTCGGTTGAGGCATCTGGACCACTGCCGCCGCCTGCGCTGCTTCGCCCGGGAGAGCTGCGGACTCATCTACTTTGAGTTTCCCGAGGAGCACCCCAACGGCCCTGCACACGGAGTGCGGATCACCGTAGAGGGCACCACCGAGTCTCACCTGGTCAGGTTCTTCACCCAGCAACCCTTCCTGGTCGAGCGGGACCGGGGCGCCACCACCTACACCGTCTACTGCATCTGTCCAACCCCGAAGTTGCATGAGAATTTTTGTTGTACTCTTTGTGGTGAGTTTAATAAAAGCTAAACTCTTGCAATACTCTGGACCTTGTCGTCGTCAACTCAACGAGACCGTCTACCTCACCAACCAGACTGAGGTAAAACTCACCTGCAGACCACACAAGACCTATATCATCTGGTTCTTCGAGAACACCTCATTTGCAGTCTCCAACACTCACTGCACTAGTCCATGAACTGATGTTGATTAAAAGCCCAAAAACCAATCAGCCCCTTCCCCCATTTCCCCATCCCCCAATTACTCATAAAAAATAAATCATTGGAATTAATCATTCAATAAAGATCACTTACTTGAAATCTGAAAGTATGTCTCTGGTGTAGTTGTTCAGCAGCACCTCGGTACCCTCCTCCCAGCTCTGGTACTCCAGTCCCCGGCGGGCGGCGAACTTCCTCCACACCTTGAAAGGGATGTCAAATTCCTGGTCCACAATTTTCATTGTCTTCCCTCTCAGATGGCAAAGAGGCTCCGGGTGGAAGATGACTTCAACCCCGTCTACCCCTATGGCTACGCGCGGAATCAGAATATCCCCTTCCTCACTCCCCCCTTTGTCTCCTCCGATGGATTCAAAAACTTCCCCCCTGGGGTCCTGTCACTTAAACTGGCTGATCCAATCACCATCAACAATGGGGATGTCTCACTTAAGGTGGGAGGGGGACTTGCTGTAGAGCAACAGACTGGTAACCTAAGCGTAAACCCTGATGCACCCTTGCAAGTTGCAAGTGATAAGCTACAGCTTGCTCTGGCTCCTCCATTCGAGGTCAGAGATGGAAAGCTTGCTTTAAAGGCAGGTAATGGATTAAAAGTACTAGATAATTCCATTACTGGATTGACTGGATTATTGAATACACTTGTGGTATTAACTGGAAGGGGAATAGGAACGGAGGAATTAAAAAATGACGATGGTGTAACAAACAAAGGAGTCGGCTTGCGTGTAAGACTTGGAGATGACGGCGGGCTGACATTTGATAAAAAGGGTGATTTAGTAGCCTGGAATAAAAAAGATGACAGGCGCACCCTGTGGACAACCCCTGACACATCTCCAAATTGCAAAATGAGTACAGAAAAGGATTCTAAACTTACGTTGACACTTACAAAGTGTGGAAGTCAGGTTCTGGGAAATGTATCTTTACTTGCAGTTACAGGTGAATATCATCAAATGACTGCTACTACAAAGAAGGATGTAAAAATATCTTTACTATTTGATGAGAATGGAATTCTATTACCATCTTCGTCCCTTAGCAAAGATTATTGGAATTACAGAAGTGATGATTCTATTGTATCTCAAAAATATAATAATGCAGTTCCATTCATGCCAAACCTGACAGCTTATCCAAAACCAAGCGCTCAAAATGCAAAAAACTATTCAAGAACTAAAATCATAAGTAATGTCTACTTAGGTGCTCTTACCTACCAACCTGTAATTATCACTATTGCATTTAATCAGGAAACTGAAAATGGATGTGCTTATTCTATAACATTTACCTTCACTTGGCAAAAAGACTATTCTGCCCAACAGTTTGATGTTACATCTTTTACCTTCTCATATCTTACCCAAGAGAACAAAGACAAAGACTAATAAAATGTTTTGAACTGAATTTATGAATCTTTATTTATTTTTACACCAGCACGGGTAGTCAGTTTCCCACCACCAGCCCATTTCACAGTGTAAACAGTCCTTTCTCCCCGGCTGGCCTTAAAAAGCATCATATCATGGGTAACAGACATATTCTTAGGTGTTATATTCCACACGGTTTCCTGTCGAGCCAAACGCTCATCAGTGATATTAATAAACTCCCCGGGCAGCTCACTTAAGTTCATGTCGCTGTCCAGCTGCTGAGCCACAGGCTGCTGTCCAACTTGCGGTTGCTTAACGGGCGGCGAAGGAGAAGTCCACGCCTACATGGGGGTAGAGTCATAATCGTGCATCAGGATAGGGCGGTGGTGCTGCAGCAGCGCGCGAATAAACTGCTGCCGCCGCCGCTCCGTCCTGCAGGAATACAACATGGCAGTGGTCTCCTCAGCGATGATTCGCACCGCCCGCAGCATAAGGCGCCTTGTCCTCCGGGCACAGCAGCGCACCCTGATCTCACTTAAATCAGCACAGTAACTGCAGCACAGCACCACAATATTGTTCAAAATCCCACAGTGCAAGGCGCTGTATCCAAAGCTCATGGCGGGGACCACAGAACCCACGTGGCCATCATACCACAAGCGCAGGTAGATTAAGTGGCGACCCCTCATAAACACGCTGGACATAAACATTACCTCTTTTGGCATGTTGTAATTCACCACCTCCCGGTACCATATAAACCTCTGATTAAACATGGCGCCATCCACCACCATCCTAAACCAGCTGGCCAAAACCTGCCCGCCGGCTATACACTGCAGGGAACCGGGACTGGAACAATGACAGTGGAGAGCCCAGGACTCGTAACCATGGATCATCATGCTCGTCATGATATCAATGTTGGCACAACACAGGCACACGTGCATACACTTCCTCAGGATTACAAGCTCCTCCCGCGTTAGAACCATATCCCAGGGAACAACCCATTCCTGAATCAGCGTAAATCCCACACTGCAGGGAAGACCTCGCACGTAACTCACGTTGTGCATTGTCAAAGTGTTACATTCGGGCAGCAGCGGATGATCCTCCAGTATGGTAGCGCGGGTTTCTGTCTCAAAAGGAGGTAGACGATCCCTACTGTACGGAGTGCGCCGAGACAACCGAGATCGTGTTGGTCGTAGTGTCATGCCAAATGGAACGCCGGACGTAGTCATTGAAATGGATTCTCTTGCGTACCTTGTCGTACTTCTGCCAGCAGAAAGTGGCTCGGGAACAGCAGATACCTTTCCTCCTGCTGTCCTTCCGCTGCTGACGCTCAGTCATCCAACTGAAGTACAGCCATTCCCGCAGGTTCTCCAGCAGCTCCTGTGCATCTGATGAAACAAAAGTCCCGTCGATGCGGATTCCCCTTAAAACATCAGCCAGGACATTGTAGGCCATCCCAATCCAGTTAATGCATCCTGATCTATCATGAAGAGGAGGTGGGGGAAGAACTGGAAGAACCATTTTTATTCCAAGCGGTCTCGAAGGACGATAAAGTGCAAGTCACGCAGGTGACAGCGTTCCCCGCCGCTGTGCTGGTGGAAACAGACAGCCAGGTCAAAACCCACTCTATTTTCAAGGTGCTCGACTGTGGCTTCGAGCAGTGGCTCTACGCGTACATCCAGCATAAGAATCACATTAAAGGCTGGACCTCCATCGATTTCATCAATCATCAGGTTACACTCATTCACCATCCCCAGGTAATTCTCATTTTTCCAGCCTTGGATTATTTCTACAAATTGTTGGTGTAAGTCCACTCCGCACATGTGGAAAAGTTCCCACAGCGCCCCCTCCACTTTCATAATCAGGCAGACCTTCATATTAGAAACAGATCCTGCTGCTCCACCACCTGCAGCGTGTTCAAAACAACAAGATTCAATGAGGTTCTGCCCTCTGCCCTCAGCTCACGTCTCAGCGTCAGCTGCAAAAAGTCACTCAAGTCCTCAGCCACTACAGCTGACAATTCAGAGCCAGGGCTAAGCGTGGGACTGGCAAGCGTGAGTGAGTACTTTAATGCTCCAAAGCTAGCACCCAAAAACTGCATGCTGGAATAAGCTCTCTTTGTGTCACCGGTGATGCCTTCCAATAGGTGAGTGATAAAGCGAGGTAGTTTTTCTTTAATCATTTGAGTAATAGAAAAGTCCTCTAAATAAGTCACTAGGACCCCAGGAACCACAATGTGGTAGCTGACAGCGTGTCGCTCAAGCATGGTTAGTAGAGATGAGAGTCTGAAAAACAGAAAGCATGCACTAAACCAGAGTTGCCAGTCTCACTGAAGGAAAAATCACTCTCTCCAGCAGCAAAGTGCCCACTGGGTGGCCCTCTCGGACATACAAAAATCGATCCGTGTGGTTAAAGAGCAGCACAGTTAGCTCCTGTCTTCTCCCAGCAAAGATCACATCGGACTGGGTTAGTATGCCCCTGGAATGGTAGTCATTCAAGGCCATAAATCTGCCTTGGTAGCCATTAGGAATCAGCACGCTCACTCTCAAGTGAACCAAAACCACCCCATGCGGAGGAATGTGGAAAGATTCTGGGCAAAAAAAGGTATATCTATTGCTAGTCCCTTCCTGGACGGGAGCAATCCCTCCAGGGCTATCTATGAAAGCATACAGAGATTCAGCCATAGCTCAGCCCGCTTACCAGTAGACAGAGAGCACAGCAGTACAAGCGCCAACAGCAGCGACTGACTACCCACTGACCCAGCTCCCTATTTAAAGGCACCTTACACTGACGTAATGACCAAAGGTCTAAAAACCCCGCCAAAAAAACACACACGCCCTGGGTGTTTTTCGCGAAAACACTTCCGCGTTCTCACTTCCTCGTATCGATTTCGTGACTCAACTTCCGGGTTCCCACGTTACGTCACTTCTGCCCTTACATGTAACTCAGCCGTAGGGCGCCATCTTGCCCACGTCCAAAATGGCTTCCATGTCCGGCCACGCCTCCGCGGCGACCGTTAGCCGTGCGTCGTGACGTCATTTGCATCACCGTTTCTCGTCCAATCAGCGTTGGCTCCGCCCCAAAACCGTTAAAATTCAAAAGCTCATTTGCATATTAACTTTTGTTTACTTTGTGGGGTATATTATTGATGATG

SEQ ID NO: 9 - DNA, 30982 bp, Artificial Sequence
  Ad26.HVRPtr13.FLuc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaactttccagccagaacctcaagtaggagaagaaaattggcaagaaactgaaagcttttatggtggtagggctcttaaaaaagacactaaaatgaaaccatgctatggatcttttgctagacctactaatgagaaaggaggtcaggcaaagttcaaaccagttaatgaaggagaacaacctaaagatctggatatagatctggctttctttgatactcccggtggcactgtgaatggccaagatgagtataaagcagacattgtcatgtacactgaaaatgttaatcttgaaacaccagacactcatgtggtttacaagccaggcaaggaagatgcaagttctgaaattaacctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 10 - DNA, 31932 bp, Artificial Sequence
  Ad26HVRPtr12.RSVF-2A-GLuc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagccagtgggagcaaaatgaaaccaatgttaataaaacacacacctttgggatggcagccatgaaaggagaagctattgacaaaaatggtctgcaaattggaactgacgcggcggatcaggataaaccaatttatgcagataaaactttccagccagaacctcaagtaggagaggaagactggattgataaagcagatttctatggcggaagagctcttaaaaaagacactaaaatgaaaccatgctatggatcttttgctagacctactaatgagaaaggaggtcaggcaaagttcaaaccagttaatgaaggagaacaacctaaagatctggatatagatatgaacttctttgacccaaccactattaacacaccagatgtagtgctgtacactgaaaatgttaatcttgaaacaccagacactcatgtggtttacaaggcaggaacttcagatgacagttctgaggtcaatttggctcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggtgtgggcactaatactgcataccaaggcgttaaagttaagacaactaatggaaacgacacgtgggaaaaagatgaaactgtttatgagtttaatcaaattggcaagggggatatctatgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 11 - DNA, 31974 bp, Artificial Sequence
  Ad26HVRPtr13.RSVF-2A-GLuc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaactttccagccagaacctcaagtaggagaagaaaattggcaagaaactgaaagcttttatggtggtagggctcttaaaaaagacactaaaatgaaaccatgctatggatcttttgctagacctactaatgagaaaggaggtcaggcaaagttcaaaccagttaatgaaggagaacaacctaaagatctggatatagatctggctttctttgatactcccggtggcactgtgaatggccaagatgagtataaagcagacattgtcatgtacactgaaaatgttaatcttgaaacaccagacactcatgtggtttacaagccaggcaaggaagatgcaagttctgaaattaacctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 12 - protein, 936 aa, Artificial Sequence
  Ad26HVRPtr1 hexon
MATPSMMPQWAYMHIAGQDASEYLSPGLVQFARATDTYFSLGNKFRNPTVAPTHDVTTDRSQRLTLRFVPVDREDTTYSYKARFTLAVGDNRVLDMASTYFDIRGVLDRGPSFKPYSGTAYNSLAPKGAPNPSQWEETSTDATTTTTHSFGLAAMKGDNITSDGLQIGTDATSGEEKPIYADKTFQPEPQIGEESWTDTDGTNEKFGGRVLKKDTKMKPCYGSFARPTNEKGGQAKFKPVNEGEQPKDLDIDMNFFDGRDAAANFTPEVVLYTENVNLETPDTHVVYKPGTSDVSSHVNLGQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLDAVGITKTYQGIKTQNGQTTTWEKDTSVSTANEIGIGNNLAMEINLQANLWKSFLYSNVALYLPDSYKYTPANVKLPANTNTYEYMNGRVVAPSLVDAYINIGARWSLDPMDNVNPFNHHRNAGLRYRSMLLGNGRYVPFHIQVPQKFFAIKNLLLLPGSYTYEWNFRKDVNMILQSSLGNDLRVDGASVRFDSVNLYATFFPMAHNTASTLEAMLRNDTNDQSFNDYLSAANMLYPIPAKATNVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQCNMTKDWFLVQMLSHYNIGYQGFHVPEGYKDRMYSFFRNFQPMSRQVVDEINYKDYKAVTLPFQHNNSGFTGYLAPTMRQGQPYPANFPYPLIGQTAVPSVTQKKFLCDRVMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 13 - DNA, 2808 bp, Artificial Sequence
  Ad26HVRPtr1 hexon
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaaactttccagccagaacctcaaataggggaagagtcatggactgatactgacggaaccaatgaaaaattcggaggaagagtccttaaaaaggacactaaaatgaaaccatgctatggatcttttgctagacctactaatgagaaaggaggtcaggcaaagttcaaaccagttaatgaaggagaacaacctaaagatctggatatagatatgaacttttttgatggtagagatgcagctgctaactttactccagaagtagtgttgtacactgaaaatgttaatcttgaaacaccagacactcatgtggtttacaagccaggaacctcagatgtgagttcccatgtcaatttgggtcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggacgctgtgggtattactaaaacttatcaaggtatcaaaacgcaaaatggtcaaactacaacgtgggaaaaggacaccagtgttagtacggccaatgaaataggcattggcaacaatcttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacc

SEQ ID NO: 14 - DNA, 2784 bp, Artificial Sequence
  Ad26HVRPtr12 hexon
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagccagtgggagcaaaatgaaaccaatgttaataaaacacacacctttgggatggcagccatgaaaggagaagctattgacaaaaatggtctgcaaattggaactgacgcggcggatcaggataaaccaatttatgcagataaaactttccagccagaacctcaagtaggagaggaagactggattgataaagcagatttctatggcggaagagctcttaaaaaagacactaaaatgaaaccatgctatggatcttttgctagacctactaatgagaaaggaggtcaggcaaagttcaaaccagttaatgaaggagaacaacctaaagatctggatatagatatgaacttctttgacccaaccactattaacacaccagatgtagtgctgtacactgaaaatgttaatcttgaaacaccagacactcatgtggtttacaaggcaggaacttcagatgacagttctgaggtcaatttggctcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggtgtgggcactaatactgcataccaaggcgttaaagttaagacaactaatggaaacgacacgtgggaaaaagatgaaactgtttatgagtttaatcaaattggcaagggggatatctatgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacc

SEQ ID NO: 15 - DNA, 2826 bp, Artificial Sequence
  Ad26HVRPtr13 hexon
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaactttccagccagaacctcaagtaggagaagaaaattggcaagaaactgaaagcttttatggtggtagggctcttaaaaaagacactaaaatgaaaccatgctatggatcttttgctagacctactaatgagaaaggaggtcaggcaaagttcaaaccagttaatgaaggagaacaacctaaagatctggatatagatctggctttctttgatactcccggtggcactgtgaatggccaagatgagtataaagcagacattgtcatgtacactgaaaatgttaatcttgaaacaccagacactcatgtggtttacaagccaggcaaggaagatgcaagttctgaaattaacctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacc

SEQ ID NO: 16 - DNA, 28287 bp, Artificial Sequence
  Ad26HVRPtr1 vector
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgaaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaaactttccagccagaacctcaaataggggaagagtcatggactgatactgacggaaccaatgaaaaattcggaggaagagtccttaaaaaggacactaaaatgaaaccatgctatggatcttttgctagacctactaatgagaaaggaggtcaggcaaagttcaaaccagttaatgaaggagaacaacctaaagatctggatatagatatgaacttttttgatggtagagatgcagctgctaactttactccagaagtagtgttgtacactgaaaatgttaatcttgaaacaccagacactcatgtggtttacaagccaggaacctcagatgtgagttcccatgtcaatttgggtcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggacgctgtgggtattactaaaacttatcaaggtatcaaaacgcaaaatggtcaaactacaacgtgggaaaaggacaccagtgttagtacggccaatgaaataggcattggcaacaatcttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatg

SEQ ID NO: 17 - DNA, 33008 bp, Artificial Sequence
  pAd26.HVR5.luc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaactttccagccagaacctcaaataggagaatctcagtggtacgaaactgaaattaatcatgcagctgggagagtccttaaaaaggacactaaaatgaaaccatgctatggatcttttgctagacctactaatgagaaaggaggtcaggcaaagttcaaaccagttaatgaaggagaacaacctaaagatctggatatagatatgcaatttttctcaactactgaggcgaccgcaggcaatggtgataacttgactcctaaagtggtattgtacactgaaaatgttaatcttgaaacaccagacactcatgtggtttacaagcccactattaaggaaggtaactcacgagaactaatgggccagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgggaggtgtgattaatacagagactcttaccaaggtaaaacctaaaacaggtcaggaaaatggatgggaaaaagatgctacagaattttcagataaaaatgaaataagagttggaaataattttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgttaattaagcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

SEQ ID NO: 18 - DNA, 33002 bp, Artificial Sequence
  pAd26.HVR35.luc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatgcatctcaatggattgcaaaaggcgtaccaactgcagcagccgcaggcaatggtgaagaagaacatgaaacagaggagaaaactgctacttacacttttgccaatgctcctgtaaaagccgaggctcaaattacaaaagagggcttaccaataggtttggagatttcagctgaaaacgaatctaaacccatctatgcagataaaactttccagccagaacctcaagtgggagatgaaacttggactgacctagacggaaaaaccgaagagtatggaggcagggctctaaagcctgacactaaaatgaaaccatgctatggatcttttgctagacctactaatgagaaaggaggtcaggcaaagttcaaaccagttaatgaaggagaacaacctaaagatctggatatagatatggaattttttgataactcatcgcaaagaacaaacttcagtcctaaaattgtcatgtacactgaaaatgttaatcttgaaacaccagacactcatgtggtttacaagcctggaacagaagacacaagttccgaagctaatttgggacagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggacggcataggtgttccaacaaccagttacaaatcaatagttccaaatggagaagataataataattggaaagaacctgaagtaaatggaacaagtgagatcggacagggtaatttgtttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgttaattaagcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

SEQ ID NO: 19 - DNA, 32933 bp, Artificial Sequence
  pAd26.HVR52.luc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccgtagagtggccggataatactaaaacaaaagtgagagcccaagcaccgtttgtaagcgacgaaatcactaaagacggcataaaggttggaacagataccgcaaccacccaacaaagcatttacgccgataaaactttccagccagaacctcaagtaggggaaacacagtggaacagcgatgtaggcactaatgataaagtggcaggaagagttttaaagaaagacactaaaatgaaaccatgctatggatcttttgctagacctactaatgagaaaggaggtcaggcaaagttcaaaccagttaatgaaggagaacaacctaaagatctggatatagatatgcagttttttgccaccactgcagccaatacaacaccaaaagctgttctttacactgaaaatgttaatcttgaaacaccagacactcatgtggtttacaagcccactgtgacagagggaacgacaagtgccgaagctttgctagcgcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgggaggaatggcggtcacagacacctactcccccataaaatccaataatggaagcggttggcaagtagacaacgatacgtttgccgacaggggggtggaaataggctcgggaaacatgttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgttaattaagcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

SEQ ID NO: 20 - DNA, 32954 bp, Artificial Sequence
  pAd26.HVRPtr1.luc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatccaagtcaatgggaagaaacttccacagatgctactactactactactcacagctttggcctggctgctatgaagggggacaatattacatctgacggtttgcagataggaacagatgctacttctggagaggaaaaacccatctatgcagataaaactttccagccagaacctcaaataggggaagagtcatggactgatactgacggaaccaatgaaaaattcggaggaagagtccttaaaaaggacactaaaatgaaaccatgctatggatcttttgctagacctactaatgagaaaggaggtcaggcaaagttcaaaccagttaatgaaggagaacaacctaaagatctggatatagatatgaacttttttgatggtagagatgcagctgctaactttactccagaagtagtgttgtacactgaaaatgttaatcttgaaacaccagacactcatgtggtttacaagccaggaacctcagatgtgagttcccatgtcaatttgggtcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggacgctgtgggtattactaaaacttatcaaggtatcaaaacgcaaaatggtcaaactacaacgtgggaaaaggacaccagtgttagtacggccaatgaaataggcattggcaacaatcttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgttaattaagcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

SEQ ID NO: 21 - DNA, 32930 bp, Artificial Sequence
  pAd26.HVRPtr12.luc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagccagtgggagcaaaatgaaaccaatgttaataaaacacacacctttgggatggcagccatgaaaggagaagctattgacaaaaatggtctgcaaattggaactgacgcggcggatcaggataaaccaatttatgcagataaaactttccagccagaacctcaagtaggagaggaagactggattgataaagcagatttctatggcggaagagctcttaaaaaagacactaaaatgaaaccatgctatggatcttttgctagacctactaatgagaaaggaggtcaggcaaagttcaaaccagttaatgaaggagaacaacctaaagatctggatatagatatgaacttctttgacccaaccactattaacacaccagatgtagtgctgtacactgaaaatgttaatcttgaaacaccagacactcatgtggtttacaaggcaggaacttcagatgacagttctgaggtcaatttggctcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggtgtgggcactaatactgcataccaaggcgttaaagttaagacaactaatggaaacgacacgtgggaaaaagatgaaactgtttatgagtttaatcaaattggcaagggggatatctatgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgttaattaagcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

SEQ ID NO: 22 - DNA, 32972 bp, Artificial Sequence
  pAd26.HVRPtr13.luc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggcattccggtactgttggtaaagccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccagccagtgggagcaagcaaaaccaggcaatgggggaactatggaaacacacacatatggtgtggccccaatgggcggagagaatattacaaaagatggtcttcaaattggaactgatgctacagcggatcagaataaaccaatttatgctgacaaaactttccagccagaacctcaagtaggagaagaaaattggcaagaaactgaaagcttttatggtggtagggctcttaaaaaagacactaaaatgaaaccatgctatggatcttttgctagacctactaatgagaaaggaggtcaggcaaagttcaaaccagttaatgaaggagaacaacctaaagatctggatatagatctggctttctttgatactcccggtggcactgtgaatggccaagatgagtataaagcagacattgtcatgtacactgaaaatgttaatcttgaaacaccagacactcatgtggtttacaagccaggcaaggaagatgcaagttctgaaattaacctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggatggatctggcactaacgccgcctatcaaggtgtaaaagtaaaaaatggtgaagatggtgatcttgagagcgagtgggaaaatgatgatactgtggcagctcgaaatcaaatatgcaaaggcaatattttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgttaattaagcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

SEQ ID NO: 23 - DNA, 2862 bp, Artificial Sequence
  Ad26HVR5 hexon
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaactttccagccagaacctcaaataggagaatctcagtggtacgaaactgaaattaatcatgcagctgggagagtccttaaaaaggacactaaaatgaaaccatgctatggatcttttgctagacctactaatgagaaaggaggtcaggcaaagttcaaaccagttaatgaaggagaacaacctaaagatctggatatagatatgcaatttttctcaactactgaggcgaccgcaggcaatggtgataacttgactcctaaagtggtattgtacactgaaaatgttaatcttgaaacaccagacactcatgtggtttacaagcccactattaaggaaggtaactcacgagaactaatgggccagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgggaggtgtgattaatacagagactcttaccaaggtaaaacctaaaacaggtcaggaaaatggatgggaaaaagatgctacagaattttcagataaaaatgaaataagagttggaaataattttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacc

SEQ ID NO: 24 - DNA, 2856 bp, Artificial Sequence
  Ad26HVR35
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatgcatctcaatggattgcaaaaggcgtaccaactgcagcagccgcaggcaatggtgaagaagaacatgaaacagaggagaaaactgctacttacacttttgccaatgctcctgtaaaagccgaggctcaaattacaaaagagggcttaccaataggtttggagatttcagctgaaaacgaatctaaacccatctatgcagataaaactttccagccagaacctcaagtgggagatgaaacttggactgacctagacggaaaaaccgaagagtatggaggcagggctctaaagcctgacactaaaatgaaaccatgctatggatcttttgctagacctactaatgagaaaggaggtcaggcaaagttcaaaccagttaatgaaggagaacaacctaaagatctggatatagatatggaattttttgataactcatcgcaaagaacaaacttcagtcctaaaattgtcatgtacactgaaaatgttaatcttgaaacaccagacactcatgtggtttacaagcctggaacagaagacacaagttccgaagctaatttgggacagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattggacggcataggtgttccaacaaccagttacaaatcaatagttccaaatggagaagataataataattggaaagaacctgaagtaaatggaacaagtgagatcggacagggtaatttgtttgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacc

SEQ ID NO: 25 - DNA, 2787 bp, Artificial Sequence
  Ad26HVR52
atggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaattccgtagagtggccggataatactaaaacaaaagtgagagcccaagcaccgtttgtaagcgacgaaatcactaaagacggcataaaggttggaacagataccgcaaccacccaacaaagcatttacgccgataaaactttccagccagaacctcaagtaggggaaacacagtggaacagcgatgtaggcactaatgataaagtggcaggaagagttttaaagaaagacactaaaatgaaaccatgctatggatcttttgctagacctactaatgagaaaggaggtcaggcaaagttcaaaccagttaatgaaggagaacaacctaaagatctggatatagatatgcagttttttgccaccactgcagccaatacaacaccaaaagctgttctttacactgaaaatgttaatcttgaaacaccagacactcatgtggtttacaagcccactgtgacagagggaacgacaagtgccgaagctttgctagcgcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgggaggaatggcggtcacagacacctactcccccataaaatccaataatggaagcggttggcaagtagacaacgatacgtttgccgacaggggggtggaaataggctcgggaaacatgttcgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggatcccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacc

SEQ ID NO: 26 - protein, 954 aa, Artificial Sequence
  Ad26HVR5
MATPSMMPQWAYMHIAGQDASEYLSPGLVQFARATDTYFSLGNKFRNPTVAPTHDVTTDRSQRLTLRFVPVDREDTTYSYKARFTLAVGDNRVLDMASTYFDIRGVLDRGPSFKPYSGTAYNSLAPKGAPNPCEWDEAATALEINLEEEDDDNEDEVDEQAEQQKTHVFGQAPYSGINITKEGIQIGVEGQTPKYADKTFQPEPQIGESQWYETEINHAAGRVLKKDTKMKPCYGSFARPTNEKGGQAKFKPVNEGEQPKDLDIDMQFFSTTEATAGNGDNLTPKVVLYTENVNLETPDTHVVYKPTIKEGNSRELMGQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLGGVINTETLTKVKPKTGQENGWEKDATEFSDKNEIRVGNNFAMEINLQANLWKSFLYSNVALYLPDSYKYTPANVKLPANTNTYEYMNGRVVAPSLVDAYINIGARWSLDPMDNVNPFNHHRNAGLRYRSMLLGNGRYVPFHIQVPQKFFAIKNLLLLPGSYTYEWNFRKDVNMILQSSLGNDLRVDGASVRFDSVNLYATFFPMAHNTASTLEAMLRNDTNDQSFNDYLSAANMLYPIPAKATNVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQCNMTKDWFLVQMLSHYNIGYQGFHVPEGYKDRMYSFFRNFQPMSRQVVDEINYKDYKAVTLPFQHNNSGFTGYLAPTMRQGQPYPANFPYPLIGQTAVPSVTQKKFLCDRVMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 27 - protein, 952 aa, Artificial Sequence
  Ad26HVR35
MATPSMMPQWAYMHIAGQDASEYLSPGLVQFARATDTYFSLGNKFRNPTVAPTHDVTTDRSQRLTLRFVPVDREDTTYSYKARFTLAVGDNRVLDMASTYFDIRGVLDRGPSFKPYSGTAYNSLAPKGAPNASQWIAKGVPTAAAAGNGEEEHETEEKTATYTFANAPVKAEAQITKEGLPIGLEISAENESKPIYADKTFQPEPQVGDETWTDLDGKTEEYGGRALKPDTKMKPCYGSFARPTNEKGGQAKFKPVNEGEQPKDLDIDMEFFDNSSQRTNFSPKIVMYTENVNLETPDTHVVYKPGTEDTSSEANLGQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLDGIGVPTTSYKSIVPNGEDNNNWKEPEVNGTSEIGQGNLFAMEINLQANLWKSFLYSNVALYLPDSYKYTPANVKLPANTNTYEYMNGRVVAPSLVDAYINIGARWSLDPMDNVNPFNHHRNAGLRYRSMLLGNGRYVPFHIQVPQKFFAIKNLLLLPGSYTYEWNFRKDVNMILQSSLGNDLRVDGASVRFDSVNLYATFFPMAHNTASTLEAMLRNDTNDQSFNDYLSAANMLYPIPAKATNVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQCNMTKDWFLVQMLSHYNIGYQGFHVPEGYKDRMYSFFRNFQPMSRQVVDEINYKDYKAVTLPFQHNNSGFTGYLAPTMRQGQPYPANFPYPLIGQTAVPSVTQKKFLCDRVMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 28 - protein, 929 aa, Artificial Sequence
  Ad26HVR52
MATPSMMPQWAYMHIAGQDASEYLSPGLVQFARATDTYFSLGNKFRNPTVAPTHDVTTDRSQRLTLRFVPVDREDTTYSYKARFTLAVGDNRVLDMASTYFDIRGVLDRGPSFKPYSGTAYNSLAPKGAPNSVEWPDNTKTKVRAQAPFVSDEITKDGIKVGTDTATTQQSIYADKTFQPEPQVGETQWNSDVGTNDKVAGRVLKKDTKMKPCYGSFARPTNEKGGQAKFKPVNEGEQPKDLDIDMQFFATTAANTTPKAVLYTENVNLETPDTHVVYKPTVTEGTTSAEALLAQQSMPNRPNYIGFRDNFVGLMYYNSTGNMGVLAGQASQLNAVVDLQDRNTELSYQLLLDSLGDRTRYFSMWNSAVDSYDPDVRIIENHGVEDELPNYCFPLGGMAVTDTYSPIKSNNGSGWQVDNDTFADRGVEIGSGNMFAMEINLQANLWKSFLYSNVALYLPDSYKYTPANVKLPANTNTYEYMNGRVVAPSLVDAYINIGARWSLDPMDNVNPFNHHRNAGLRYRSMLLGNGRYVPFHIQVPQKFFAIKNLLLLPGSYTYEWNFRKDVNMILQSSLGNDLRVDGASVRFDSVNLYATFFPMAHNTASTLEAMLRNDTNDQSFNDYLSAANMLYPIPAKATNVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQCNMTKDWFLVQMLSHYNIGYQGFHVPEGYKDRMYSFFRNFQPMSRQVVDEINYKDYKAVTLPFQHNNSGFTGYLAPTMRQGQPYPANFPYPLIGQTAVPSVTQKKFLCDRVMWRIPFSSNFMSMGALTDLGQNMLYANSAHALDMTFEVDPMDEPTLLYLLFEVFDVVRVHQPHRGVIEAVYLRTPFSAGNATT

SEQ ID NO: 29 - DNA, 8806 bp, Artificial Sequence
  pAdApt26.ApoA1.RSVF-2A-GLuc
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgacctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggttggccgtgctcttcctgacgggtaggtgtcccctaacctagggagccaaccatcggggggccttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttcgtcgacatggaactgctgatcctgaaggccaacgccatcaccaccatcctgaccgccgtgaccttctgcttcgccagcggccagaacatcaccgaggaattctaccagagcacctgtagcgccgtgtccaagggctacctgagcgccctgcggaccggctggtacaccagcgtgatcaccatcgagctgagcaacatcaaaaagaacaagtgcaacggcaccgacgccaaaatcaagctgatcaagcaggaactggacaagtacaagaacgccgtgaccgagctgcagctgctgatgcagagcacccccgccaccaacaaccgggccagacgggagctgccccggttcatgaactacaccctgaacaacgccaaaaagaccaacgtgaccctgagcaagaagcggaagcggcggttcctgggcttcctgctgggcgtgggcagcgccattgctagcggagtggctgtgtctaaggtgctgcacctggaaggcgaagtgaacaagatcaagtccgccctgctgagcaccaacaaggccgtggtgtccctgagcaacggcgtgtccgtgctgaccagcaaggtgctggatctgaagaactacatcgacaagcagctgctgcccatcgtgaacaagcagagctgcagcatcagcaacatcgagacagtgatcgagttccagcagaagaacaaccggctgctggaaatcacccgcgagttcagcgtgaacgccggcgtgaccacccccgtgtccacctacatgctgaccaacagcgagctgctgagcctgatcaacgacatgcccatcaccaacgaccagaaaaagctgatgagcaacaacgtgcagatcgtgcggcagcagagctactccatcatgtccatcatcaaagaagaggtgctggcctacgtggtgcagctgcccctgtacggcgtgatcgacaccccctgctggaagctgcacaccagccccctgtgcaccaccaacaccaaagagggcagcaacatctgcctgacccggaccgaccggggctggtactgcgataatgccggcagcgtgtcattctttccacaagccgagacatgcaaggtgcagagcaaccgggtgttctgcgacaccatgaacagcctgaccctgcccagcgaggtgaacctgtgcaacgtggacatcttcaaccctaagtacgactgcaagatcatgacctccaagaccgacgtgtccagctccgtgatcacctccctgggcgccatcgtgtcctgctacggcaagaccaagtgcaccgccagcaacaagaaccggggcatcatcaagaccttcagcaacggctgcgactacgtgtccaacaagggcgtggacaccgtgtccgtgggcaacaccctgtactacgtgaacaaacaggaaggcaagagcctgtacgtgaagggcgagcccatcatcaacttctacgaccccctggtgttccccagcgacgagttcgacgccagcatcagccaggtcaacgagaagatcaaccagagcctggccttcatcagaaagagcgacgagctgctgcacaatgtgaatgccgtgaagtccaccaccaatatcatgatcaccacaatcatcatcgtgatcatcgtcatcctgctgtccctgatcgccgtgggcctgctgctgtactgcaaggcccggtccacccctgtgaccctgtccaaggaccagctgagcggcatcaacaatatcgccttctccaacggacgcgtgaccgagctgctttaccggatgaagcgggctgagacatattgcccgagacccctgttggcaatccatcctactgaggctcgccacaaacagaaaatcgtggcccccgtcaaacagacactcaattttgacttgttgaaacttgcaggagatgttgagtcaaaccccgggcctatgggcgtcaaggtcctgttcgctctgatttgtatcgctgtcgctgaagctaagccaaccgagaataatgaagactttaatatcgtggccgtggcttctaacttcgctaccacagacctggatgcagacaggggaaagctgccaggcaagaaactgcccctggaggtcctgaaggagatggaagcaaatgcccggaaagccgggtgcacaagaggatgcctgatttgtctgagccacatcaagtgcactcctaagatgaagaagttcatccccggccggtgccatacctacgagggcgataaggaatccgcccagggaggaatcggagaggctatcgtggatattcccgaaatccctggcttcaaagacctggagcccatggaacagtttattgcacaggtggatctgtgcgtcgactgtactaccggatgcctgaagggactggcaaacgtccagtgtagcgacctgctgaagaaatggctgcctcagcgatgtgctacatttgccagcaagattcagggccaggtggacaagattaagggagcaggaggcgactgataattctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagattaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaatcga

It is claimed:

1. An adenoviral vector comprising a nucleic acid sequence encoding a hexon polypeptide comprising a hexon hypervariable regions-encompassing polypeptide comprising an amino acid sequence selected from SEQ ID NO:1 or SEQ ID NO:2.

2. The adenoviral vector of claim 1, wherein the hexon polypeptide sequence comprises SEQ ID NO:3 or SEQ ID NO:4.

3. The adenoviral vector of claim 1, wherein the adenoviral vector further comprises an E1 deletion.

4. The adenoviral vector of claim 1, wherein the adenoviral vector further comprises an E3 deletion.

5. The adenoviral vector of claim 1, wherein the adenoviral vector further comprises a human adenovirus-5 (HAdV-5) E4 orf6.

6. The adenoviral vector of claim 1, wherein the adenoviral vector comprises a nucleic acid sequence selected from SEQ ID NO:5 or SEQ ID NO:6.

7. The adenoviral vector of claim 1, wherein the adenoviral vector further comprises at least one transgene.

8. The adenoviral vector of claim 1, wherein the transgene is located at the E1 deletion, at the E3 deletion, and/or adjacent to the right inverted terminal repeat (rITR).

9. The adenoviral vector of claim 1, wherein the adenoviral vector comprises one or more nucleic acid sequences from human adenovirus-26 (Ad26).

10. A recombinant cell comprising the adenoviral vector of claim 1.

11. A method of producing an adenoviral vector, comprising:
    (a) growing the recombinant cell of claim 10 under conditions for production of the adenoviral vector; and
    (b) isolating the adenoviral vector from the recombinant cell.

12. An immunogenic composition comprising the adenoviral vector of claim 1 and a pharmaceutically acceptable carrier.

13. A method of inducing an immune response in a subject in need thereof, the method comprising administering to the subject the immunogenic composition of claim 12.

14. A method of producing an immunogenic composition, the method comprising combining an adenoviral vector according to claim 1 with a pharmaceutically acceptable carrier.

* * * * *